US011326182B2

(12) United States Patent
Paul et al.

(10) Patent No.: US 11,326,182 B2
(45) Date of Patent: May 10, 2022

(54) COMPOSITIONS FOR THE TREATMENT OF DISEASE

(71) Applicant: VOYAGER THERAPEUTICS, INC., Cambridge, MA (US)

(72) Inventors: Steven Paul, Cambridge, MA (US); Donna T. Ward, Groton, MA (US)

(73) Assignee: Voyager Therapeutics, Inc., Cambridge, MA (US)

( * ) Notice: Subject to any disclaimer, the term of this patent is extended or adjusted under 35 U.S.C. 154(b) by 0 days.

(21) Appl. No.: 16/097,418

(22) PCT Filed: Apr. 28, 2017

(86) PCT No.: PCT/US2017/030054
§ 371 (c)(1),
(2) Date: Oct. 29, 2018

(87) PCT Pub. No.: WO2017/189959
PCT Pub. Date: Nov. 2, 2017

(65) Prior Publication Data
US 2019/0153471 A1    May 23, 2019

Related U.S. Application Data

(60) Provisional application No. 62/367,317, filed on Jul. 27, 2016, provisional application No. 62/329,442, filed on Apr. 29, 2016.

(51) Int. Cl.
*C12N 15/86* (2006.01)
*A61K 48/00* (2006.01)
*C07K 16/00* (2006.01)

(52) U.S. Cl.
CPC .......... *C12N 15/86* (2013.01); *C07K 16/00* (2013.01); *A61K 48/00* (2013.01); *C07K 2319/095* (2013.01); *C07K 2319/50* (2013.01); *C12N 2750/14143* (2013.01); *C12N 2840/203* (2013.01)

(58) Field of Classification Search
CPC .......... C12N 15/86; C12N 2840/203; C12N 2750/14143; C12N 15/8645; C12N 2710/14143; C12N 2750/14141; C07K 16/00; C07K 2319/50; C07K 2319/095; C07K 2317/14; C07K 16/18; C07K 14/005; C07K 2317/565; C07K 14/4711; A61K 48/00; A61P 25/00; A61P 25/28
See application file for complete search history.

(56) References Cited

U.S. PATENT DOCUMENTS

| | | |
|---|---|---|
| 5,064,764 A | 11/1991 | Besnainon |
| 5,474,935 A | 12/1995 | Chatterjee |
| 5,587,308 A | 12/1996 | Carter |
| 5,652,224 A | 7/1997 | Wilson |
| 5,658,785 A | 8/1997 | Johnson |
| 5,688,676 A | 11/1997 | Zhou |
| 5,691,176 A | 11/1997 | Lebkowski |
| 5,693,531 A | 12/1997 | Chiorini |
| 5,741,683 A | 4/1998 | Zhou |
| 5,756,283 A | 5/1998 | Wilson |
| 5,856,152 A | 1/1999 | Wilson |
| 5,858,351 A | 1/1999 | Podsakoff |
| 5,858,775 A | 1/1999 | Johnson |
| 5,866,552 A | 2/1999 | Wilson |
| 5,866,696 A | 2/1999 | Carter |
| 5,871,982 A | 2/1999 | Wilson |
| 5,952,221 A | 9/1999 | Kurtzman |
| 5,962,313 A | 10/1999 | Podsakoff |
| 5,989,540 A | 11/1999 | Carter |
| 6,083,716 A | 7/2000 | Wilson |
| 6,143,548 A | 11/2000 | ORiordan |
| 6,143,567 A | 11/2000 | Van Agthoven |
| 6,146,874 A | 11/2000 | Zolotukhin |
| 6,156,303 A | 12/2000 | Russell |
| 6,174,527 B1 | 1/2001 | Wilson |
| 6,180,613 B1 | 1/2001 | Kaplitt |
| 6,194,191 B1 | 2/2001 | Zhang |
| 6,200,560 B1 | 3/2001 | Couto |
| 6,204,059 B1 | 3/2001 | Samulski |
| 6,211,163 B1 | 4/2001 | Podsakoff |
| 6,251,677 B1 | 6/2001 | Wilson |
| 6,258,595 B1 | 7/2001 | Gao |

(Continued)

FOREIGN PATENT DOCUMENTS

| | | |
|---|---|---|
| CN | 101186925 | 5/2008 |
| CN | 101186925 A | 5/2008 |

(Continued)

OTHER PUBLICATIONS

ClinicalTrials.gov Identifier: NCT01656525, Jun. 2014. (Year: 2014).*
Mingozzi et al., www.ScienceTranslationalMedicine.org Jul. 17, 2013, vol. 5 Issue 194:194ra92. (Year: 2013).*
Freese, A. et al., Epilesia 38:759-766. (Year: 1997).*
Janeway et al. Immunobiology: The Immune System in Health and Disease. 5th edition. New York: Garland Science; (Year: 2001).*
Schmid et al., Nature Communications, 9:450, (Year: 2018).*
Database accession No. CS791068, Oct. 30, 2007, "Sequence 6 from patent WO2007068429".
Kou JH, et al. Catalytic Immunoglobulin Gene Delivery in a Mouse Model of Alzheimer's Disease: Prophylactic and Therapeutic Applications. Mol Neurobiol. Feb. 2015,51(1):43-56.

(Continued)

*Primary Examiner* — Kimberly Ballard
*Assistant Examiner* — Stacey N MacFarlane
(74) *Attorney, Agent, or Firm* — McCarter & English, LLP; Maria Laccotripe Zacharakis; Yu Lu

(57) ABSTRACT

The invention provides compositions and methods for the preparation, manufacture and therapeutic use of viral vectors, such as adeno-associated virus (AAV) particles having viral genomes encoding one or more antibodies or antibody fragments or antibody like polypeptides, for the prevention and/or treatment of diseases and/or disorders.

24 Claims, 3 Drawing Sheets
Specification includes a Sequence Listing.

(56) References Cited

U.S. PATENT DOCUMENTS

| | | |
|---|---|---|
| 6,261,551 B1 | 7/2001 | Wilson |
| 6,265,389 B1 | 7/2001 | Burke |
| 6,270,996 B1 | 8/2001 | Wilson |
| 6,274,354 B1 | 8/2001 | Wilson |
| 6,281,010 B1 | 8/2001 | Gao |
| 6,325,998 B1 | 12/2001 | Podsakoff |
| 6,335,011 B1 | 1/2002 | Podsakoff |
| 6,365,394 B1 | 4/2002 | Gao |
| 6,387,368 B1 | 5/2002 | Wilson |
| 6,399,385 B1 | 6/2002 | Croyle |
| 6,410,300 B1 | 6/2002 | Samulski |
| 6,416,992 B1 | 7/2002 | Mejza |
| 6,428,988 B1 | 8/2002 | Wilson |
| 6,436,392 B1 | 8/2002 | Engelhardt |
| 6,436,394 B1 | 8/2002 | Henderson |
| 6,468,524 B1 | 10/2002 | Chiorini |
| 6,468,771 B1 | 10/2002 | Einerhand |
| 6,475,769 B1 | 11/2002 | Wilson |
| 6,482,634 B1 | 11/2002 | Wilson |
| 6,485,966 B2 | 11/2002 | Gao |
| 6,503,888 B1 | 1/2003 | Kaplitt |
| 6,509,150 B1 | 1/2003 | Salvetti |
| 6,521,426 B1 | 2/2003 | Ciliberto |
| 6,555,525 B2 | 4/2003 | Burke |
| 6,566,118 B1 | 5/2003 | Atkinson |
| 6,582,692 B1 | 6/2003 | Podsakoff |
| 6,593,123 B1 | 7/2003 | Wright |
| 6,610,290 B2 | 8/2003 | Podsakoff |
| 6,642,051 B1 | 11/2003 | Lynch |
| 6,660,514 B1 | 12/2003 | Zolotukhin |
| 6,660,521 B2 | 12/2003 | Brough |
| 6,670,176 B1 | 12/2003 | Samulski |
| 6,676,935 B2 | 1/2004 | Henderson |
| 6,699,706 B1 | 3/2004 | Brooks |
| 6,710,036 B2 | 3/2004 | Kurtzman |
| 6,723,551 B2 | 4/2004 | Kotin |
| 6,726,907 B1 | 4/2004 | Zhang |
| 6,753,419 B1 | 6/2004 | Toniatti |
| 6,759,237 B1 | 7/2004 | Wilson |
| 6,846,665 B1 | 1/2005 | Horer |
| 6,855,314 B1 | 2/2005 | Chiorini |
| 6,887,463 B2 | 5/2005 | Wilson |
| 6,897,045 B2 | 5/2005 | Engelhardt |
| 6,936,466 B2 | 8/2005 | Feldhaus |
| 6,943,019 B2 | 9/2005 | Wilson |
| 6,953,690 B1 | 10/2005 | Gao |
| 6,984,517 B1 | 1/2006 | Chiorini |
| 6,995,006 B2 | 2/2006 | Atkinson |
| 7,015,026 B2 | 3/2006 | ORiordan |
| 7,022,519 B2 | 4/2006 | Gao |
| 7,048,920 B2 | 5/2006 | Yu |
| 7,056,502 B2 | 6/2006 | Hildinger |
| 7,070,998 B2 | 7/2006 | Johnson |
| 7,091,030 B2 | 8/2006 | Setiawan |
| 7,094,604 B2 | 8/2006 | Snyder |
| 7,105,345 B2 | 9/2006 | Wilson |
| 7,112,321 B2 | 9/2006 | Wang |
| 7,125,705 B2 | 10/2006 | Colosi |
| 7,125,706 B2 | 10/2006 | Zhang |
| 7,169,612 B2 | 1/2007 | Kostenis |
| 7,186,552 B2 | 3/2007 | Wilson |
| 7,198,951 B2 | 4/2007 | Gao |
| 7,223,585 B2 | 5/2007 | Coffey |
| 7,235,393 B2 | 6/2007 | Gao |
| 7,238,526 B2 | 7/2007 | Wilson |
| 7,241,447 B1 | 7/2007 | Engelhardt |
| 7,247,472 B2 | 7/2007 | Wilson |
| 7,271,002 B2 | 9/2007 | Kotin |
| 7,282,199 B2 | 10/2007 | Gao |
| 7,291,498 B2 | 11/2007 | Roy |
| 7,300,797 B2 | 11/2007 | Van Agthoven |
| 7,306,794 B2 | 12/2007 | Wilson |
| 7,319,002 B2 | 1/2008 | Wilson |
| 7,326,555 B2 | 2/2008 | Konz |
| 7,344,872 B2 | 3/2008 | Gao |
| 7,419,817 B2 | 9/2008 | Chiorini |
| 7,419,956 B2 | 9/2008 | Ohtaki |
| 7,445,930 B2 | 11/2008 | Zhang |
| 7,479,554 B2 | 1/2009 | Chiorini |
| 7,491,508 B2 | 2/2009 | Roy |
| 7,510,872 B2 | 3/2009 | Clark |
| 7,510,875 B2 | 3/2009 | Zhang |
| 7,579,181 B2 | 8/2009 | ORiordan |
| 7,625,570 B1 | 12/2009 | Schaffer |
| 7,638,120 B2 | 12/2009 | Liu |
| 7,662,627 B2 | 2/2010 | Johnson |
| 7,704,492 B2 | 4/2010 | Podsakoff |
| 7,704,721 B2 | 4/2010 | Wright |
| 7,732,129 B1 | 6/2010 | Zhang |
| 7,790,449 B2 | 9/2010 | Gao |
| 7,803,622 B2 | 9/2010 | Engelhardt |
| 7,838,277 B2 | 11/2010 | Gao |
| 7,888,096 B2 | 2/2011 | Wu |
| 7,901,921 B2 | 3/2011 | Coffey |
| 7,906,111 B2 | 3/2011 | Wilson |
| 7,968,333 B2 | 6/2011 | Yu |
| 8,105,574 B2 | 1/2012 | Wilson |
| 8,110,351 B2 | 2/2012 | Bosnes |
| 8,137,948 B2 | 3/2012 | Qu |
| 8,163,543 B2 | 4/2012 | Urabe |
| 8,231,880 B2 | 7/2012 | Roy |
| 8,236,495 B2 | 8/2012 | Nochumson |
| 8,241,622 B2 | 8/2012 | Englehardt |
| 8,273,344 B2 | 9/2012 | Wang |
| 8,283,151 B2 | 10/2012 | Schmidt |
| 8,318,480 B2 | 11/2012 | Gao |
| 8,318,687 B2 | 11/2012 | Tabira |
| 8,394,386 B2 | 3/2013 | Wilson |
| 8,409,842 B2 | 4/2013 | Clark |
| 8,470,310 B2 | 6/2013 | Roy |
| 8,476,418 B2 | 7/2013 | Mueller |
| 8,512,981 B2 | 8/2013 | Hermens |
| 8,524,219 B2 | 9/2013 | Roy |
| 8,524,446 B2 | 9/2013 | Gao |
| 8,603,459 B2 | 12/2013 | Wilson |
| 8,614,101 B2 | 12/2013 | VanDine |
| 8,637,255 B2 | 1/2014 | Wilson |
| 8,642,314 B2 | 2/2014 | Bakker |
| 8,685,734 B2 | 4/2014 | Coffey |
| 8,697,417 B2 | 4/2014 | Bakker |
| 8,697,665 B2 | 4/2014 | Rom |
| 8,834,863 B2 | 9/2014 | Roy |
| 8,846,030 B2 | 9/2014 | Engelhardt |
| 8,846,389 B2 | 9/2014 | Chiorini |
| 8,865,881 B2 | 10/2014 | Balazs |
| 8,906,387 B2 | 12/2014 | Kay |
| 8,906,675 B2 | 12/2014 | Gao |
| 8,927,514 B2 | 1/2015 | Chatterjee |
| 8,962,330 B2 | 2/2015 | Gao |
| 8,962,332 B2 | 2/2015 | Gao |
| 8,999,678 B2 | 4/2015 | Vandenberghe |
| 9,051,542 B2 | 6/2015 | Wright |
| 9,056,892 B2 | 6/2015 | Pun |
| 9,062,101 B2 | 6/2015 | Barghorn |
| 9,067,996 B2 | 6/2015 | Strakhova |
| 9,080,183 B2 | 7/2015 | Klein |
| 9,089,667 B2 | 7/2015 | Bankiewicz |
| 9,102,722 B2 | 8/2015 | Mueller |
| 9,102,943 B2 | 8/2015 | Shinmura |
| 9,115,373 B2 | 8/2015 | Hermens |
| 9,163,260 B2 | 10/2015 | Wilson |
| 9,217,155 B2 | 12/2015 | Gao |
| 9,217,159 B2 | 12/2015 | Roy |
| 9,228,174 B2 | 1/2016 | Noordman |
| 9,233,174 B2 | 1/2016 | Chen |
| 9,238,800 B2 | 1/2016 | Bossis |
| 9,260,724 B2 | 2/2016 | Bakker |
| 9,303,072 B2 | 4/2016 | Wang |
| 9,394,360 B2 | 7/2016 | Barghorn |
| 9,439,979 B2 | 9/2016 | Chiorini |
| 9,441,038 B2 | 9/2016 | Wu |
| 9,441,206 B2 | 9/2016 | Grieger |
| 9,441,244 B2 | 9/2016 | Schaffer |
| 9,447,179 B2 | 9/2016 | Winderickx |

(56) References Cited

U.S. PATENT DOCUMENTS

| | | |
|---|---|---|
| 9,447,433 B2 | 9/2016 | Hirsch |
| 9,457,103 B2 | 10/2016 | Schaffer |
| 9,458,517 B2 | 10/2016 | Schaffer |
| 9,464,119 B2 | 10/2016 | Sonntag |
| 9,469,688 B2 | 10/2016 | Benatuil |
| 9,469,689 B2 | 10/2016 | Chen |
| 9,475,845 B2 | 10/2016 | Asokan |
| 9,475,868 B2 | 10/2016 | Woolf |
| 9,481,735 B2 | 11/2016 | Hsieh |
| 9,487,578 B2 | 11/2016 | Gordon |
| 9,487,802 B2 | 11/2016 | Quake |
| 9,493,788 B2 | 11/2016 | Gao |
| 9,506,083 B2 | 11/2016 | Arbetman |
| 9,512,203 B2 | 12/2016 | Baty |
| 9,518,101 B2 | 12/2016 | Novak |
| 9,527,904 B2 | 12/2016 | Balazs |
| 9,528,126 B2 | 12/2016 | Qu |
| 9,540,659 B2 | 1/2017 | Davidson |
| 9,546,112 B2 | 1/2017 | Voit |
| 9,546,369 B2 | 1/2017 | Gao |
| 9,567,376 B2 | 2/2017 | Cronin |
| 9,567,607 B2 | 2/2017 | Wilson |
| 9,580,691 B2 | 2/2017 | Bakker |
| 9,585,971 B2 | 3/2017 | Deverman |
| 9,587,250 B2 | 3/2017 | Gao |
| 9,587,282 B2 | 3/2017 | Schaffer |
| 9,592,284 B2 | 3/2017 | Wilson |
| 9,593,346 B2 | 3/2017 | Roy |
| 9,596,835 B2 | 3/2017 | Gao |
| 9,597,363 B2 | 3/2017 | Roy |
| 9,598,468 B2 | 3/2017 | Weigel-Van Aken |
| 9,598,703 B2 | 3/2017 | Garcia |
| 9,611,302 B2 | 4/2017 | Srivastava |
| 9,617,561 B2 | 4/2017 | Roy |
| 9,623,120 B2 | 4/2017 | Chatterjee |
| 9,624,274 B2 | 4/2017 | Lux |
| 9,636,370 B2 | 5/2017 | McCown |
| 9,658,224 B2 | 5/2017 | Siegel |
| 9,670,507 B2 | 6/2017 | Xiao |
| 9,676,841 B2 | 6/2017 | Chennamsetty |
| 9,677,088 B2 | 6/2017 | Nakai |
| 9,677,089 B2 | 6/2017 | Gao |
| 10,041,090 B2 | 8/2018 | Gao |
| 10,047,155 B2 | 8/2018 | Chen |
| 2001/0006955 A1 | 7/2001 | Wilson |
| 2001/0049144 A1 | 12/2001 | Rivera |
| 2002/0019050 A1 | 2/2002 | Gao |
| 2002/0037867 A1 | 3/2002 | Wilson |
| 2002/0081721 A1 | 6/2002 | Allen |
| 2002/0090717 A1 | 7/2002 | Gao |
| 2002/0102714 A1 | 8/2002 | Wilson |
| 2002/0131961 A1 | 9/2002 | Wilson |
| 2003/0013189 A1 | 1/2003 | Wilson |
| 2003/0032613 A1 | 2/2003 | Gao |
| 2003/0092161 A1 | 5/2003 | Gao |
| 2003/0100115 A1 | 5/2003 | Raj |
| 2003/0119191 A1 | 6/2003 | Gao |
| 2003/0138772 A1 | 7/2003 | Gao |
| 2004/0043490 A1 | 3/2004 | Shimada |
| 2004/0057931 A1 | 3/2004 | Wilson |
| 2004/0136963 A1 | 7/2004 | Wilson |
| 2004/0171807 A1 | 9/2004 | Gao |
| 2005/0261218 A1 | 11/2005 | Esau |
| 2006/0003451 A1 | 1/2006 | Gao |
| 2006/0204479 A1 | 9/2006 | Wilson |
| 2007/0004042 A1 | 1/2007 | Gao |
| 2008/0008684 A1 | 1/2008 | Wilson |
| 2008/0050343 A1 | 2/2008 | Wilson |
| 2008/0050345 A1 | 2/2008 | Wilson |
| 2008/0075737 A1 | 3/2008 | Gao |
| 2008/0275220 A1* | 11/2008 | Friess .............. A61K 39/39591 530/387.3 |
| 2009/0215871 A1 | 8/2009 | Wilson |
| 2009/0275107 A1 | 11/2009 | Lock |
| 2009/0317417 A1 | 12/2009 | Vandenberghe |
| 2010/0035973 A1 | 2/2010 | Walker |
| 2010/0247490 A1 | 9/2010 | Roy |
| 2010/0278791 A1 | 11/2010 | Wilson |
| 2011/0071214 A1 | 3/2011 | Allen |
| 2011/0136227 A1 | 6/2011 | Bakker |
| 2011/0171262 A1 | 7/2011 | Bakker |
| 2011/0223135 A1 | 9/2011 | Roy |
| 2011/0229971 A1 | 9/2011 | Knop |
| 2011/0274691 A1 | 11/2011 | Arvedson |
| 2012/0046349 A1 | 2/2012 | Bell |
| 2012/0058102 A1 | 3/2012 | Wilson |
| 2012/0093853 A1 | 4/2012 | Wilson |
| 2012/0137379 A1 | 5/2012 | Gao |
| 2012/0258046 A1 | 10/2012 | Mutzke |
| 2013/0023033 A1 | 1/2013 | Wilson |
| 2013/0045186 A1 | 2/2013 | Gao |
| 2013/0101558 A1 | 4/2013 | Gao |
| 2013/0195801 A1 | 8/2013 | Gao |
| 2013/0202618 A1 | 8/2013 | Ma |
| 2013/0296532 A1 | 11/2013 | Hermens |
| 2013/0323226 A1 | 12/2013 | Wilson |
| 2013/0323302 A1 | 12/2013 | Constable |
| 2014/0031418 A1 | 1/2014 | Wilson |
| 2014/0044680 A1 | 2/2014 | Roy |
| 2014/0044794 A1 | 2/2014 | Okada |
| 2014/0065105 A1 | 3/2014 | Wilson |
| 2014/0087361 A1 | 3/2014 | Dobbelaer |
| 2014/0099666 A1 | 4/2014 | Rossomando |
| 2014/0107186 A1 | 4/2014 | Garcia |
| 2014/0336245 A1 | 11/2014 | Mingozzi |
| 2014/0341852 A1 | 11/2014 | Srivastava |
| 2014/0342434 A1 | 11/2014 | Hermens |
| 2015/0005369 A1 | 1/2015 | Muzyczka |
| 2015/0010578 A1 | 1/2015 | Balazs |
| 2015/0023924 A1 | 1/2015 | High |
| 2015/0065562 A1 | 3/2015 | Yazicioglu |
| 2015/0118287 A1 | 4/2015 | Hammond |
| 2015/0139952 A1 | 5/2015 | Webster |
| 2015/0159173 A1 | 6/2015 | Vandenberghe |
| 2015/0166610 A1 | 6/2015 | Baudoux |
| 2015/0182638 A1 | 7/2015 | Crystal |
| 2015/0190501 A1 | 7/2015 | Weber |
| 2015/0203585 A1 | 7/2015 | Mi |
| 2015/0210771 A1 | 7/2015 | Crystal |
| 2015/0218261 A1 | 8/2015 | Barghorn |
| 2015/0230430 A1 | 8/2015 | Wilson |
| 2015/0232533 A1 | 8/2015 | Chen |
| 2015/0238610 A1 | 8/2015 | Sista |
| 2015/0307898 A2 | 10/2015 | Hermens |
| 2015/0315610 A1 | 11/2015 | Nishie |
| 2015/0374803 A1 | 12/2015 | Wolfe |
| 2016/0032319 A1 | 2/2016 | Wright |
| 2016/0108373 A1 | 4/2016 | Bennett |
| 2016/0153992 A1 | 6/2016 | Buening |
| 2016/0264649 A1 | 9/2016 | Chan-Hui |
| 2016/0264680 A1 | 9/2016 | Poul |
| 2016/0271192 A1 | 9/2016 | Roy |
| 2016/0272703 A1 | 9/2016 | Hsieh |
| 2016/0273058 A1 | 9/2016 | Akashika |
| 2016/0280791 A1 | 9/2016 | Ghayur |
| 2016/0289275 A1 | 10/2016 | Chiorini |
| 2016/0289278 A1 | 10/2016 | Bakaletz |
| 2016/0296638 A1 | 10/2016 | Crystal |
| 2016/0296694 A1 | 10/2016 | Bankiewicz |
| 2016/0297885 A1 | 10/2016 | Kuo |
| 2016/0304591 A1 | 10/2016 | Kelley |
| 2016/0317677 A1 | 11/2016 | Bhatia |
| 2016/0319000 A1 | 11/2016 | Woolf |
| 2016/0319033 A1 | 11/2016 | Chardes |
| 2016/0326238 A1 | 11/2016 | Barghorn |
| 2016/0331897 A1 | 11/2016 | Anand |
| 2016/0333372 A1 | 11/2016 | Srivastava |
| 2016/0333373 A1 | 11/2016 | Farley |
| 2016/0333375 A1 | 11/2016 | Chen |
| 2016/0339090 A1 | 11/2016 | Hacohen |
| 2016/0340393 A1 | 11/2016 | Schaffer |
| 2016/0340418 A1 | 11/2016 | Baron |
| 2016/0340692 A1 | 11/2016 | Wang |
| 2016/0347850 A1 | 12/2016 | Benatuil |

(56) References Cited

U.S. PATENT DOCUMENTS

| | | |
|---|---|---|
| 2016/0354465 A1 | 12/2016 | Mi |
| 2016/0355573 A1 | 12/2016 | Crystal |
| 2016/0355577 A1 | 12/2016 | Kelley |
| 2016/0355583 A1 | 12/2016 | Chen |
| 2016/0361439 A1 | 12/2016 | Agbandje-McKenna |
| 2016/0369298 A1 | 12/2016 | Marsic |
| 2016/0369299 A1 | 12/2016 | Boye |
| 2016/0375151 A1 | 12/2016 | Schaffer |
| 2016/0376323 A1 | 12/2016 | Schaffer |
| 2016/0376608 A1 | 12/2016 | Chou |
| 2017/0000904 A1 | 1/2017 | Wilson |
| 2017/0002075 A1 | 1/2017 | Gu |
| 2017/0007669 A1 | 1/2017 | Sarkar |
| 2017/0007679 A1 | 1/2017 | Maeder |
| 2017/0007720 A1 | 1/2017 | Boye |
| 2017/0008964 A1 | 1/2017 | Batt |
| 2017/0015742 A1 | 1/2017 | Gu |
| 2017/0022269 A1 | 1/2017 | Barghorn |
| 2017/0022281 A1 | 1/2017 | Anderson |
| 2017/0022292 A1 | 1/2017 | Eder |
| 2017/0028082 A1 | 2/2017 | Wilson |
| 2017/0035905 A1 | 2/2017 | Abrams |
| 2017/0043035 A1 | 2/2017 | Wilson |
| 2017/0044504 A1 | 2/2017 | Schaffer |
| 2017/0049909 A1 | 2/2017 | Cullen |
| 2017/0067028 A1 | 3/2017 | Ballon |
| 2017/0071972 A1 | 3/2017 | Buj Bello |
| 2017/0073685 A1 | 3/2017 | Maeder |
| 2017/0073703 A1 | 3/2017 | Chatterjee |
| 2017/0088605 A1 | 3/2017 | Abend |
| 2017/0088625 A1 | 3/2017 | Tedder |
| 2017/0088631 A1 | 3/2017 | Ast |
| 2017/0088858 A1 | 3/2017 | Gao |
| 2017/0096470 A1 | 4/2017 | Ghayur |
| 2017/0096646 A1 | 4/2017 | Roy |
| 2017/0105927 A1 | 4/2017 | Thorne |
| 2017/0106095 A1 | 4/2017 | Batt |
| 2017/0112878 A1 | 4/2017 | Kaufmann |
| 2017/0112946 A1 | 4/2017 | Ikeda |
| 2017/0114130 A1 | 4/2017 | Rondon |
| 2017/0114364 A9 | 4/2017 | Allison |
| 2017/0121734 A1 | 5/2017 | Cairns |
| 2017/0128594 A1 | 5/2017 | Wright |
| 2017/0130208 A1 | 5/2017 | Potter |
| 2017/0130245 A1 | 5/2017 | Kotin |
| 2017/0137532 A1 | 5/2017 | Liu |
| 2017/0145440 A1 | 5/2017 | Hermens |
| 2017/0151345 A1 | 6/2017 | Shah |
| 2017/0151348 A1 | 6/2017 | Kaspar |
| 2017/0151416 A1 | 6/2017 | Kutikov |
| 2017/0152324 A1 | 6/2017 | Baty |
| 2017/0152525 A1 | 6/2017 | Hermens |
| 2017/0157212 A1 | 6/2017 | Jones |
| 2017/0157267 A1 | 6/2017 | Kay |
| 2017/0159026 A1 | 6/2017 | Kay |
| 2017/0159027 A1 | 6/2017 | Wilson |
| 2017/0159072 A9 | 6/2017 | Arbeit |
| 2017/0165377 A1 | 6/2017 | Gao |
| 2017/0166625 A1 | 6/2017 | Di Clemente |
| 2017/0166871 A1 | 6/2017 | Nishie |
| 2017/0166923 A1 | 6/2017 | Goepfert |
| 2017/0166925 A1 | 6/2017 | Gao |
| 2017/0166926 A1 | 6/2017 | Deverman |
| 2017/0166927 A1 | 6/2017 | Gao |
| 2018/0222967 A1 | 8/2018 | Li |
| 2018/0235887 A1 | 8/2018 | Garidel |
| 2018/0237511 A1 | 8/2018 | Beil |
| 2018/0243411 A1 | 8/2018 | June |
| 2018/0243416 A1 | 8/2018 | Limberis |
| 2018/0244746 A1 | 8/2018 | Mallone |

FOREIGN PATENT DOCUMENTS

| | | |
|---|---|---|
| EP | 1015619 | 7/2000 |
| EP | 1046711 | 10/2000 |
| EP | 1078096 | 2/2001 |
| EP | 1164195 | 12/2001 |
| EP | 1183380 | 3/2002 |
| EP | 1218035 | 7/2002 |
| EP | 1240345 | 9/2002 |
| EP | 1279740 | 1/2003 |
| EP | 1453547 | 9/2004 |
| EP | 1578253 | 9/2005 |
| EP | 1696036 | 8/2006 |
| EP | 1847614 | 10/2007 |
| EP | 1849872 | 10/2007 |
| EP | 1857552 | 11/2007 |
| EP | 1944043 | 7/2008 |
| EP | 2007795 | 12/2008 |
| EP | 2188310 | 5/2010 |
| EP | 2198016 | 6/2010 |
| EP | 2217697 | 8/2010 |
| EP | 2220241 | 8/2010 |
| EP | 2220242 | 8/2010 |
| EP | 2287191 | 2/2011 |
| EP | 2292779 | 3/2011 |
| EP | 2325298 | 5/2011 |
| EP | 2359866 | 8/2011 |
| EP | 2383346 | 11/2011 |
| EP | 2524037 | 11/2012 |
| EP | 2531604 | 12/2012 |
| EP | 2660325 | 11/2013 |
| EP | 2678433 | 1/2014 |
| EP | 2737071 | 6/2014 |
| EP | 2814958 | 12/2014 |
| EP | 2851374 | 3/2015 |
| EP | 2871239 | 5/2015 |
| EP | 2879719 | 6/2015 |
| EP | 2933336 | 10/2015 |
| EP | 2975053 | 1/2016 |
| EP | 2981552 | 2/2016 |
| EP | 3058959 | 8/2016 |
| EP | 3067417 | 9/2016 |
| EP | 3068801 | 9/2016 |
| EP | 3077408 | 10/2016 |
| EP | 3083696 | 10/2016 |
| EP | 2176283 | 11/2016 |
| EP | 3091033 | 11/2016 |
| EP | 3108000 | 12/2016 |
| EP | 3112380 | 1/2017 |
| EP | 3117005 | 1/2017 |
| EP | 3126386 | 2/2017 |
| EP | 3134431 | 3/2017 |
| EP | 3149038 | 4/2017 |
| EP | 3149039 | 4/2017 |
| EP | 3160990 | 5/2017 |
| EP | 3160991 | 5/2017 |
| EP | 3168298 | 5/2017 |
| EP | 3177643 | 6/2017 |
| EP | 3356405 | 8/2018 |
| EP | 3360570 | 8/2018 |
| EP | 3362472 | 8/2018 |
| EP | 3363816 | 8/2018 |
| EP | 3363817 | 8/2018 |
| EP | 3365369 | 8/2018 |
| EP | 3443006 A2 | 2/2019 |
| WO | 1990007936 | 7/1990 |
| WO | 1993009239 | 5/1993 |
| WO | 1995034670 | 12/1995 |
| WO | 1996017947 | 6/1996 |
| WO | 1996023810 | 8/1996 |
| WO | 1996030540 | 10/1996 |
| WO | 1998010088 | 3/1998 |
| WO | 1999027110 | 6/1999 |
| WO | 1999043360 | 9/1999 |
| WO | 1999058700 | 11/1999 |
| WO | 1999061595 | 12/1999 |
| WO | 1999060146 | 5/2000 |
| WO | 2000024916 | 5/2000 |
| WO | 2000028061 | 5/2000 |
| WO | 2000066780 | 11/2000 |
| WO | 2000075353 | 12/2000 |
| WO | 2001014539 | 3/2001 |
| WO | 2001023001 | 4/2001 |

(56) References Cited

FOREIGN PATENT DOCUMENTS

| | | |
|---|---|---|
| WO | 2001025465 | 4/2001 |
| WO | 2001032711 | 5/2001 |
| WO | 2001036623 | 5/2001 |
| WO | 2001042444 | 6/2001 |
| WO | 2001068888 | 9/2001 |
| WO | 2001096587 | 12/2001 |
| WO | 2002012525 | 2/2002 |
| WO | 2002014487 | 2/2002 |
| WO | 2002020748 | 3/2002 |
| WO | 2002070719 | 9/2002 |
| WO | 2002071843 | 9/2002 |
| WO | 2003010320 | 2/2003 |
| WO | 2003024502 | 3/2003 |
| WO | 2003042397 | 5/2003 |
| WO | 2003087382 | 10/2003 |
| WO | 2003087383 | 10/2003 |
| WO | 2004044003 | 5/2004 |
| WO | 2004083441 | 9/2004 |
| WO | 2004108922 | 12/2004 |
| WO | 2004111248 | 12/2004 |
| WO | 2007/068429 A1 | 6/2007 |
| WO | 2008081008 | 7/2008 |
| WO | 2013082114 A1 | 6/2013 |
| WO | 2015/035190 A1 | 3/2015 |
| WO | 2015/175639 A1 | 11/2015 |
| WO | WO/2015/171907 * 11/2015 ............. G01N 33/50 |  |
| WO | 2015191508 A1 | 12/2015 |
| WO | 2016007741 A1 | 1/2016 |
| WO | 2016081811 | 5/2016 |
| WO | 2016081927 | 5/2016 |
| WO | 2016115382 | 7/2016 |
| WO | 2016122791 | 8/2016 |
| WO | 2016126857 | 8/2016 |
| WO | 2016130591 | 8/2016 |
| WO | 2016137949 | 9/2016 |
| WO | 2016141244 | 9/2016 |
| WO | 2016141245 | 9/2016 |
| WO | 2016149695 | 9/2016 |
| WO | 2016149698 | 9/2016 |
| WO | 2016149710 | 9/2016 |
| WO | 2016154055 | 9/2016 |
| WO | 2016154344 | 9/2016 |
| WO | 2016156291 | 10/2016 |
| WO | 2016160976 | 10/2016 |
| WO | 2016164609 | 10/2016 |
| WO | 2016168728 | 10/2016 |
| WO | 2016172008 | 10/2016 |
| WO | 2016172155 | 10/2016 |
| WO | 2016179496 | 11/2016 |
| WO | 2016183236 | 11/2016 |
| WO | 2016183297 | 11/2016 |
| WO | 2016187068 | 11/2016 |
| WO | 2016188911 | 12/2016 |
| WO | 2016191418 | 12/2016 |
| WO | 2016196507 | 12/2016 |
| WO | 2016196975 | 12/2016 |
| WO | 2016197367 | 12/2016 |
| WO | 2016198500 | 12/2016 |
| WO | 2016200543 | 12/2016 |
| WO | 2016203432 | 12/2016 |
| WO | 2017004514 | 1/2017 |
| WO | 2017005806 | 1/2017 |
| WO | 2017005923 | 1/2017 |
| WO | 2017011342 | 1/2017 |
| WO | 2017011413 | 1/2017 |
| WO | 2017011414 | 1/2017 |
| WO | 2017015102 | 1/2017 |
| WO | 2017015619 | 1/2017 |
| WO | 2017019876 | 2/2017 |
| WO | 2017019994 | 2/2017 |
| WO | 2017020858 | 2/2017 |
| WO | 2017021893 | 2/2017 |
| WO | 2017023863 | 2/2017 |
| WO | 2017024515 | 2/2017 |
| WO | 2017027805 | 2/2017 |
| WO | 2017040312 | 3/2017 |
| WO | 2017040528 | 3/2017 |
| WO | 2017042701 | 3/2017 |
| WO | 2017049266 | 3/2017 |
| WO | 2017053170 | 3/2017 |
| WO | 2017058892 | 4/2017 |
| WO | 2017070284 | 4/2017 |
| WO | 2017070476 | 4/2017 |
| WO | 2017070516 | 4/2017 |
| WO | 2017070525 | 4/2017 |
| WO | 2017070678 | 4/2017 |
| WO | 2017072150 | 5/2017 |
| WO | 2017074878 | 5/2017 |
| WO | 2017075335 | 5/2017 |
| WO | 2017075475 | 5/2017 |
| WO | 2017079479 | 5/2017 |
| WO | 2017079768 | 5/2017 |
| WO | 2017083423 | 5/2017 |
| WO | 2017091512 | 6/2017 |
| WO | 2017093330 | 6/2017 |
| WO | 2017095823 | 6/2017 |
| WO | 2017096039 | 6/2017 |
| WO | 2017100671 | 6/2017 |
| WO | 2017100674 | 6/2017 |
| WO | 2017100676 | 6/2017 |
| WO | 2017100704 | 6/2017 |
| WO | 2018144535 | 8/2018 |
| WO | 2018146230 | 8/2018 |
| WO | 2018146594 | 8/2018 |
| WO | 2018148454 | 8/2018 |
| WO | 2018152435 | 8/2018 |
| WO | 2018189611 | 10/2018 |
| WO | 2019027847 | 2/2019 |

OTHER PUBLICATIONS

Communication pursuant to Rule 164(1) EPC dated Dec. 18, 2019 in corresponding European application No. 17790505.6 entitled, "Compositions for the Treatment of Disease".

Adachi K, et al. Drawing a high-resolution functional map of adeno-associated virus capsid by massively parallel sequencing. Nat Commun. 2014;5:3075. doi: 10.1038/ncomms4075.

Adam VS, et al. Adeno-associated virus 9-mediated airway expression of antibody protects old and immunodeficient mice against influenza virus. Clin Vaccine Immunol. Nov. 2014;21(11):1528-33.

Adamson-Small L, et al. Sodium chloride enhances rAAV production in a serum-free suspension manufacturing platform using the Herpes Simplex Virus System. Hum Gene Ther Methods. Feb. 2017;28(1):1-14.

Afione S, et al. Identification and Mutagenesis of the Adeno-Associated Virus 5 Sialic Acid Binding Region.J Virol. Feb. 2015, 89(3):1660-72.

Ahmed SS, et al. rAAV gene therapy in a Canavan's disease mouse model reveals immune impairments and an extended pathology beyond the central nervous system. Mol Ther Jun. 2016;24(6):1030-41.

Ai J, et al. A Scalable and Accurate Method for Quantifying Vector Genomes of Recombinant Adeno-Associated Viruses in Crude Lysate. Hum Gene Ther Methods Apr. 13, 2017. Epub ahead of print.

Ai J, et al. Adeno-associated virus serotype rh.10 displays strong muscle tropism following intraperitoneal delivery. Sci Rep. Jan. 2017;7:40336.

Alton EW, et al. Repeated nebulisation of non-viral CFTR gene therapy in patients with cystic fibrosis: a randomised, double-blind, placebo-controlled, phase 2b trial. Lancet Respir Med Sep. 2015;3(9):684-91.

Altschul SF, et al. Basic local alignment search tool. J Mol Biol. Oct. 5, 1990;215(3):403-10.

Alves S et al. Ultramicroscopy as a Novel Tool to Unravel the Tropism of AAV Gene Therapy Vectors in the Brain. Sci Rep. Jun. 20, 2016;6:28272.

Amaro IA et al. An Intrabody Drug (rAAV6-INT41) Reduces the Binding of N-Terminal Huntingtin Fragment(s) to DNA to Basal

(56) References Cited

OTHER PUBLICATIONS

Levels in PC12 Cells and Delays Cognitive Loss in the R6/2 Animal Model. J Neurodegen Dis. 2016;2016:7120753.
Aoyama Y, et al. Wnt11 gene therapy with adeno-associated virus 9 improves the survival of mice with myocarditis induced by coxsackievirus B3 through the suppression of the inflammatory reaction. J Mol Cell Cardiol. Jul. 2015;84:45-51.
Aubourg P. Gene therapy for rare central nervous system diseases comes to age. Endocr Dev. 2016;30:141-6.
Aydemir F, et al. Mutants at the 2-fold interface of AAV2 structural proteins suggest a role in viral transcription for AAV capsids. J Virol. Jul. 2016;90(16):7196-204.
Badamchi-Zadeh A, et al. Therapeutic Efficacy of Vectored PGT121 Gene Delivery in HIV-1-Infected Humanized Mice. J. Virol.
Bankiewicz KS et al. AAV Viral Vector Delivery to the Brain by Shape-conforming MR-guided Infusions. J Control Release. Oct. 28, 2016;240:434-442.
Bantel-Schaal U, et al. Human adeno-associated virus type 5 is only distantly related to other known primate helper-dependent parvoviruses. J Virol. Feb. 1999;73(2):939-47.
Baruch et al. PD-1 immune checkpoint blockade reduces pathology and improves memory in mouse models of Alzheimer's disease. Nature Medicine vol. 22, pp. 135-137 (2016).
Baum BJ, et al. Advances in salivary gland gene therapy—oral and systemic implications. Expert Opinion on Biological Therapy. 2015;15(10):1443-54.
Baum BJ, et al. Early responses to adenoviral-mediated transfer of the aquaporin-1 cDNA for radiation-induced salivary hypofunction. Proc Natl Acad Sci U S A. Nov. 20, 2012;109(47):19403-7.
Bell P, et al. Effects of self-complementarity, codon optimization, transgene, and dose on liver transduction with AAV8. Hum Gene Ther Methods. Dec. 2016;27(6):228-237.
Bensky MJ, et al. Targeted gene delivery to the enteric nervous system using AAV: a comparison across serotypes and capsid mutants.Mol Ther Mar. 2015;23(3):488-500.
Berge SM Pharmaceutical salts. J Pharm Sci. Jan. 1977;66(1):1-19.
Berry GE, et al. Cellular transduction mechanisms of adeno-associated viral vectors. Curr Opin Virol. Dec. 2016;21:54-60.
Bey K, et al. Efficient CNS targeting in adult mice by intrathecal infusion of single-stranded AAV9-GFP for gene therapy of neurological disorders. Gene Ther. Apr. 20, 2017. Epub ahead of print.
Brady JM, et al. Antibody gene transfer with adeno-associated viral vectors as a method for HIV prevention. Immunol Rev. Jan. 2017;275(1):324-333.
Brulet R, et al. NEUROD1 Instructs Neuronal Conversion in Non-Reactive Astrocytes. Stem Cell Reports. May 11, 2017. Epub ahead of print.
Buclez PO, et al. Rapid, scalable, and low-cost purification of recombinant adeno-associated virus produced by baculovirus expression vector system. Mol Ther Methods Clin Dev. May 2016;3:16035.
Burnham B, et al. Analytical ultracentrifugation as an approach to characterize recombinant adeno-associated viral vectors. Hum Gene Ther Methods. Dec. 2015;26(6):228-42.
Cabral-Miranda F, et al. rAAV8-733-Mediated Gene Transfer of CHIP/Stub-1 Prevents Hippocampal Neuronal Death in Experimental Brain Ischemia. Mol Ther. Feb. 2017;25(2):392-400.
Carillo H, et al. The Multiple Sequence Alignment Problem in Biology. SIAM J. Appl. Math. 48-5 (1988), pp. 1073-1082.
Carter BJ. Adeno-associated virus and the development of adeno-associated virus vectors: a historical perspective. Mol Ther. Dec. 2004;10(6):981-9.
Castle MJ, et al. Controlling AAV Tropism in the Nervous System with Natural and Engineered Capsids. Methods Mol Biol. 2016;1382:133-49.
Chamberlain K, et al. Expressing transgenes that exceed the packaging capacity of AAV capsids. Hum Gene Ther Methods. Feb. 2016;27(1):1-12.
Chandler RJ, et al. rAAV integration and genotoxicity: insights from animal models. Hum Gene Ther. Apr. 2017;28(4):314-322.
Chandler RJ, et al. Systemic AAV9 gene therapy improves the lifespan of mice with Niemann-Pick disease, type C1. Hum Mol Genet. Jan. 2017;26(1):52-64.
Chatterjee D, et al. Proteasome-targeted nanobodies alleviate pathology and functional decline in an α-synuclein-based Parkinson's disease model. NPJ Parkinsons Dis. Aug. 22, 2018;4:25.
Chen M, et al. Efficient Gene Delivery and Expression in Pancreas and Pancreatic Tumors by Capsid-optimized AAV8 Vectors. Hum Gene Ther Methods. Feb. 2017;28(1):49-59.
Chiorini JA, et al. Adeno-associated virus (AAV) type 5 Rep protein cleaves a unique terminal resolution site compared with other AAV serotypes. J Virol. May 1999;73(5):4293-8.
Chiorini JA, et al. Cloning and characterization of adeno-associated virus type 5. J Virol. Feb. 1999;73(2):1309-19.
Chiorini JA, et al. Cloning of adeno-associated virus type 4 (AAV4) and generation of recombinant AAV4 particles. J Virol. Sep. 1997;71(9):6823-33.
Choudhury et al. In Vivo Selection Yields AAV-B1 Capsid for Central Nervous System and Muscle Gene Therapy. Mol Ther. Aug. 2016;24(7):1247-57.
Choudhury SR, et al. Widespread CNS gene transfer and silencing after systemic delivery of novel AAV-AS vectors. Mol Ther. Apr. 2016;24(4):726-35.
Clement N, et al. Manufacturing of recombinant adeno-associated viral vectors for clinical trials. Mol Ther Methods Clin Dev. Mar. 2016;3:16002.
D'Costa S, et al. Practical utilization of recombinant AAV vector reference standards: focus on vector genome titration by free ITR qPCR. Mol Ther Methods Clin Dev. Mar. 2016;5:16019.
Dang CH, et al. In vivo dynamics of AAV-mediated gene delivery to sensory neurons of the trigeminal ganglia. Sci Rep. Apr. 19, 2017;7(1):927.
Dashkoff J, et al. Tailored transgene expression to specific cell types in the central nervous system after peripheral injection with AAV9. Mol Ther Methods Clin Dev. Dec. 2016;3:16081.
Davidsson M, et al. A novel process of viral vector barcoding and library preparation enables high-diversity library generation and recombination-free paired-end sequencing. Sci Rep. Nov. 2016;6:3563.
Davis AS, et al. Rational design and engineering of a modified adeno-associated virus (AAV1)-based vector system for enhanced retrograde gene delivery. Neurosurgery. Feb. 2015;76(2):216-25.
De Leeuw CN et al. rAAV-compatible MiniPromoters for Restricted Expression in the Brain and Eye. Mol Brain. May 10, 2016;9(1):52.
Wu XL, et al. Tandem bispecific neutralizing antibody eliminates HIV-1 infection in humanized mice. J Clin Invest Jun. 1, 2018;128(6):2239-2251.
Xiao P, et al. Disruption of microtubules post virus entry enhances adeno-associated virus vector transduction. Hum Gene Ther. Apr. 2016;27(4):309-24.
Xie J, et al. Short DNA Hairpins Compromise Recombinant Adeno-Associated Virus Genome Homogeneity. Mol Ther. Apr. 24, 2017. Epub ahead of print.
Xie Q, et al. The 2.8 Å Electron Microscopy Structure of Adeno-Associated Virus-DJ Bound by a Heparinoid Pentasaccharide. Mol Ther Methods Clin Dev. Mar. 8, 2017;5:1-12.
Xie Q, et al. The atomic structure of adeno-associated virus (AAV-2), a vector for human gene therapy. Proc Natl Acad Sci U S A. Aug. 6, 2002;99(16):10405-10. Epub Jul. 22, 2002.
Yalvac ME, et al. AAV1.NT-3 gene therapy attenuates spontaneous autoimmune peripheral polyneuropathy. Gene Ther. Jan. 2016;23(1):95-102.
Yan ZY, et al. Optimization of recombinant adeno-associated virus mediated expression for large transgenes, using a synthetic promoter and tandem array enhancers. Hum Gene Ther. Jun. 2015;26(6):334-46.
Yang C, et al. Sequential adeno-associated viral vector serotype 9-green fluorescent protein gene transfer causes massive inflammation and intense immune response in rat striatum. Hum Gene Ther. Jul. 2016;27(7):528-43.
Ye L., et al. Adeno-Associated Virus Vector Mediated Delivery of the HBV Genome Induces Chronic Hepatitis B Virus Infection and Liver Fibrosis in Mice. PLoS One. Jun. 2015, 10(6):e0130052.

(56) References Cited

OTHER PUBLICATIONS

Zeng C, et al. Probing the Link between Genomic Cargo, Contact Mechanics and Nanoindentation in Recombinant Adeno-Associated Virus 2. J Phys Chem B. Mar. 2017;121(8):1843-1853.
Zhao KN, et al. BPV1 E2 protein enhances packaging of full-length plasmid DNA in BPV1 pseudovirions. Virology. Jul. 5, 2000;272(2):382-93.
Zhu W, et al. Soluble FLT1 Gene Therapy Alleviates Brain Arteriovenous Malformation Severity. Stroke. May 2017;48(5):1420-1423.
Zinn E, et al. In Silico Reconstruction of the Viral Evolutionary Lineage Yields a Potent Gene Therapy Vector. Cell Rep. Aug. 2015, 12(6):1056-68.
Zou W, et al. Nonstructural protein NP1 of human bocavirus 1 plays a critical role in the expression of viral capsid proteins. J Virol. Apr. 2016;90(9):4658-69.
Baruch, K et al. PD-1 Immune Checkpoint Blockade Reduces Pathology and Improves Memory in Mouse Models of Alzheimer's Disease. Nature Medicine. Jan. 18, 2016, vol. 22, pp. 135-137.
International Search Report & Written Opinion dated Oct. 4, 2017 in co-pending application No. PCT/US2017/030054, entitled Compositions for the Treatment of Disease.
Salegio EA, et al. MRI-Guided Delivery of Viral Vectors. Methods Mol Viol. 2016;1382:217-30.
Samaranch L et al. Cerebellomedullary Cistern Delivery for AAV-Based Gene Therapy: A Technical Note for Nonhuman Primates. Hum Gene Ther Methods. Feb. 2016;27(1):13-6.
Samaranch L, et al. MR-guided parenchymal delivery of adeno-associated viral vector serotype 5 in non-human primate brain. Gene Ther. Apr. 2017;24(4):253-261.
Samulski RJ, et al. Helper-free stocks of recombinant adeno-associated viruses: normal integration does not require viral gene expression. J Virol. Sep. 1989;63(9):3822-8.
Saraiva J et al. Gene Therapy for the CNS Using AAVs: The Impact of Systemic Delivery by AAV9. J Control Release. Nov. 10, 2016;241:94-109.
Sawada Y et al. Inflammation-induced Reversible Switch of the Neuron-specific Enolase Promoter from Purkinje Neurons to Bergmann Glia. Sci Rep. Jun. 13, 2016;6:27758.
Schnepp BC, et al. Recombinant adeno-associated virus vector genomes take the form of long-lived transcriptionally competent episomes in human muscle. Hum Gene Ther. Jan. 2016;27(1):32-42.
Schnepp BC, et al. Vector mediated antibody gene transfer for infectious disease. Adv Exp Med Biol. 2015;848:149-67.
Shen F, et al. Inhibition of pathological brain angiogenesis through systemic delivery of AAV vector expressing soluble FLT1. Gene Therapy. Nov. 22, 2015(11):893-900.
Shen S, et al. Functional Analysis of the Putative Integrin Recognition Motif on Adeno-associated virus 9. J Biol Chem. Jan. 2015, 290(3):1496-504.
Shen W, et al. Analysis of the Cis and Trans Requirements for DNA Replication at the Right End Hairpin of the Human Bocavirus 1 Genome. J Virol. Aug. 2016;90(17):7761-77.
Singer J, et al. Proof of concept study with an HER-2 mimotope anticancer vaccine deduced from a novel AAV-mimotope library platform. Oncoimmunology. Apr. 2016;5(7):e1171446.
Siu JJ, et al. Improved gene delivery to adult mouse spinal cord through the use of engineered hybrid adeno-associated viral serotypes. Gene Ther. Apr. 25, 2017. Epub ahead of print.
Smith DW, et al. Biocomputing: Informatics and Genome Projects. Academic Press, New York, 1993.
Smith RH, et al. A simplified baculovirus-AAV expression vector system coupled with one-step affinity purification yields high-titer rAAV stocks from insect cells. Mol Ther. Nov. 2009;17(11):1888-96. doi: 10.1038/mt.2009.128. Epub Jun. 16, 2009.
Smith RH, et al. Germline viral "fossils" guide in silico reconstruction of a mid-Cenozoic era marsupial adeno-associated virus. Sci Rep. Jul. 2016;6:28965.
Sondhi D, et al. Genetic Modification of the Lung Directed Toward Treatment of Human Disease. Hum Gene Ther. Jan. 2017;28(1):3-84.

Srivastava A, et al. Nucleotide sequence and organization of the adeno-associated virus 2 genome. J Virol. Feb. 1983;45(2):555-64.
Srivastava A. Adeno-Associated Virus: The Naturally Occurring Virus Versus the Recombinant Vector. Hum Gene Ther. Jan. 2016;27(1):1-6.
Srivastava A. In Vivo Tissue-tropism of Adeno-associated Viral Vectors. Curr Opin Virol. Sep. 2, 2016;21:75-80.
Stahl PH, et al. Pharmaceutical Salts: Properties, Selection, and Use. Wiley-VCH, 2008.
Steines B, et al. CFTR gene transfer with AAV improves early cystic fibrosis pig phenotypes. JCI Insight. Sep. 2016;1(14):e88728.
Su W et al. Recombinant adeno-associated viral (rAAV) vectors mediate efficient gene transduction in cultured neonatal and adult microglia. J Neurochem. Jan. 2016;136 Suppl 1:49-62.
Summerford C, et al. AAVR: A multi-serotype receptor for AAV. Mol Ther. Apr. 2016;24(4):663-6.
Suzuki J, et al. Cochlear gene therapy with ancestral AAV in adult mice: complete transduction of inner hair cells without cochlear dysfunction. Apr. 3, 2017;7:45524.
Tarantal AF, et al. Systemic and Persistent Muscle Gene Expression in Rhesus Monkeys with a Liver De-targeted Adeno-Associated Virus (AAV) Vector. Hum Gene Ther. May 2017;28(5):385-391.
Tervo et al. A Designer AAV Variant Permits Efficient Retrograde Access to Projection Neurons. Neuron. Oct. 19, 2016;92(2):372-382.
Thorne B, et al. Gene Therapy. Adv Biochem Eng Biotechnol. Mar. 14, 2017 Epub ahead of print.
Tratschin JD, et al. Adeno-associated virus vector for high-frequency integration, expression, and rescue of genes in mammalian cells. Mol Cell Biol. Nov. 1985;5(11):3251-60.
Tse LV, et al. Mapping and engineering function domains of the assembly-activating protein of adeno-associated viruses. J. Virol. Jun. 29, 2018;92(14).
Tu MY, et al. Role of capsid proteins in parvoviruses infection. Virol J. Aug. 2015, 4;12:114.
Urabe M, et al. Scalable generation of high-titer recombinant adeno-associated virus type 5 in insect cells. J Virol. Feb. 2006;80(4):1874-85.
Van Der Loo JCM, et al. Progress and challenges in viral vector manufacturing. Hum Mol Genet. Apr. 2016;25(R1): R42-52.
Van Lieshout LP, et al. A Novel Triple-Mutant AAV6 Capsid Induces Rapid and Potent Transgene Expression in the Muscle and Respiratory Tract of Mice. Mol Ther Meth Clin Dev Jun. 15, 2018.
Vercauteren K, et al. Superior in vivo Transduction of Human Hepatocytes Using Engineered AAV3 Capsid. Mol Ther. Jun. 2016;24(6):1042-9.
Verhelle A, et al. AAV9 delivered bispecific nanobody attenuates amyloid burden in the gelsolin amyloidosis mouse model. Hum Mol Genet. Apr. 2017;26(7):1353-1364.
Vitale F, et al. Anti-tau conformational scFv MC1 antibody efficiently reduces pathological tau species in adult JNPL3 mice. Acta Neuropathol. Commun Aug. 22, 2018;6(1):82.
Von Heinje G. Sequence Analysis in Molecular Biology. Academic Press, 1987.
Wang et al., Noninvasive, neuron-specific gene therapy can be facilitated by focused ultrasound and recombinant adeno-associated virus. Gene Therapy. Nov. 22, 2014, 104-110.
Wang L, et al. Productive life cycle of adeno-associated virus serotype 2 in the complete absence of a conventional polyadenylation signal. J Gen Virol. Sep. 2015;96(9):2780-7.
Wang LL, et al. Comparative study of liver gene transfer with AAV vectors based on endogenous and engineered AAV capsids. Mol Ther. Dec. 2015;23(12):1877-87.
Wang M, et al. Direct interaction of human serum proteins with AAV virions to enhance AAV transduction: Immediate impact on clinical applications. Gene Ther. Jan. 2017;24(1):49-59.
Wang S, et al. Direct brain infusion can be enhanced with focused ultrasound and microbubbles. J Cereb Blood Flow Metab. Feb. 2017;37(2):706-714.
Wasilko DJ, et al. The titerless infected-cells preservation and scale-up (TIPS) method for large-scale production of NO-sensitive human soluble guanylate cyclase (sGC) from insect cells infected

(56) References Cited

OTHER PUBLICATIONS with recombinant baculovirus. Protein Expr Purif. Jun. 2009;65(2):122-32. doi: 10.1016/j.pep.2009.01.002. Epub Jan. 11, 2009.
Watakabe A, et al. Comparative analyses of adeno-associated viral vector serotypes 1 2 5 8 and 9 in marmoset mouse and macaque cerebral cortex. Neurosci Res.Apr. 2015, 93:144-57.
Watson ZL, et al. Adeno-associated Virus Vectors Efficiently Transduce Mouse and Rabbit Sensory Neurons Coinfected with Herpes Simplex Virus 1 following Peripheral Inoculation. J Virol. Aug. 12, 2016;90(17):7894-901.
Weber-Adrian D, et al. Gene delivery to the spinal cord using MRI-guided focused ultrasound. Gene Ther. Jul. 2015, 22(7):568-77.
Woodard KT et al. Heparan Sulfate Binding Promotes Accumulation of Intravitreally Delivered Adeno-associated Viral Vectors at the Retina for Enhanced Transduction but Weakly Influences Tropism. J Virol. Oct. 14, 2016;90(21):9878-9888.
Wu D et al. Expressing Constitutively Active Rheb in Adult Dorsal Root Ganglion Neurons Enhances the Integration of Sensory Axons that Regenerate Across a Chondroitinase-Treated Dorsal Root Entry Zone Following Dorsal Root Crush. Front Mol Neurosci. Jul. 5, 2016;9:49.
Wu P, et al. Mutational analysis of the adeno-associated virus type 2 (AAV2) capsid gene and construction of AAV2 vectors with altered tropism. J Virol. Sep. 2000;74(18):8635-47.
Martinez-Navio JM, et al. Host anti-antibody responses following adeno-associated virus mediated delivery of antibodies against HIV and SIV in Rhesus monkeys. Mol Ther. Feb. 2016;24(1):76-86.
Mason JB, et al. Delivery and evaluation of recombinant adeno-associated viral vectors in the equine distal extremity for the treatment of laminitis. Equine Vet J. Jan. 2017;49(1):79-86.
Matsuzaki Y, Konno A, Mochizuki R, Shinohara Y, Nitta K, Okada Y, Hirai H. Neurosci Lett. Nov. 23, 2017. [Epub ahead of print].
McClements ME, et al. A fragmented adeno-associated viral dual vector strategy for treatment of diseases caused by mutations in large genes leads to expression of hybrid transcripts. J Genet Syndr Gene Ther. Nov. 2016;7(5):311.
Mendell Jr, et al. Follistatin Gene Therapy for Sporadic Inclusion Body Myositis Improves Functional Outcomes. Mol Ther. Apr. 2017;25(4):870-879.
Merkel SF et al. Trafficking of AAV Vectors Across a Model of the Blood-Brain Barrier; a Comaparative Study of Transcytosis and Transduction Using Primary Human Brain Endothelial Cells. J Neurochem. Oct. 8, 2016.
Merten OW, et al. Viral vectors for gene therapy and gene modification approaches. Biochem Eng J. Apr. 2016;108:98-115.
Methods in Molecular Biology, ed. Richard, Humana Press, NJ (1995).
Mietzsch M, et al. OneBac 2.0: Sf9 Cell Lines for Production of AAV1, AAV2 and AAV8 Vectors with Minimal Encapsidation of Foreign DNA Hum Gene Ther Methods. Feb. 2017;28(1):15-22.
Mietzsch M, et al. OneBac 2.0: Sf9 cell lines for production of AAV5 vectors with enhanced infectivity and minimal encapsidation of foreign DNA. Hum Gene Ther. Oct. 26, 2015(10):688-97.
Mingozzi F, et al. Adeno-associated viral vectors at the frontier between tolerance and immunity. Front Immunol.Mar. 2015, 6:120.
Miyanohara A et al. Potent Spinal Parenchymal AAV9-mediated Gene Delivery by Subpial Injection in Adult Rats and Pigs. Mol Ther Methods Clin Dev. Jul. 13, 2016;3:16046.
Morabito G, Giannelli SG, Ordazzo G, Bido S, Castoldi V, Indrigo M, Cabassi T, Cattaneo S, Luoni M, Cancellieri C, Sessa A, Bacigaluppi M, Taverna S, Leocani L, Lanciego JL, Broccoli V. Mol Ther. Dec. 6, 2017;25(12):2727-2742. Epub Aug. 10, 2017.
Muralidharan G et al. Unique glycan signatures regulate adeno-associated virus tropism in the developing brain. J Virol. Apr. 2015;89(7):3976-87.
Murlidharan G et al. Glymphatic Fluid Transport Controls Paravascular Clearance of AAV Vectors from the Brain. JCI Insight. Sep. 8, 2016;1(14).
Myers EW, et al. Optimal alignments in linear space. Comput Appl Biosci. Mar. 1988;4(1):11-7.
Naidoo J, et al. Extensive Transduction and Enhanced Spread of a Modified AAV2 Capsid in the Non-human Primate CNS. Mol Ther. Jul. 12, 2018 Epub ahead of print.
Nambiar B, et al. Characteristics of minimally oversized adeno-associated virus vectors encoding human Factor VIII generated using producer cell lines and triple transfection. Hum Gene Ther Methods. Feb. 2017;28(1):23-38.
Nery FC, et al. New methods for investigation of neuronal migration in embryonic brain explants J Neurosci Methods.Jan. 2015, 239:80-4.
Neuberger EWI, et al. Establishment of two quantitative nested qPCR assays targeting the human EPO transgene. Gene Ther Apr. 2016;23(4):330-9.
Nicolson SC, et al. Identification and validation of small molecules that enhance recombinant Adeno-associated virus transduction following high throughput screen. J Virol. Jul. 2016;90(16):7019-31.
Nygaard S, et al. A universal system to select gene-modified hepatocytes in vivo. Sci Transl Med. Jun. 2016;8(342):342ra79.
O'Reilly DR, et al. Baculovirus expression vectors: a laboratory manual. Oxford University Press, 1994.
Ojala DS, et al. Adeno-associated virus vectors and neurological gene therapy. Neuroscientist. Feb. 2015;21(1):84-98.
Oliva B, et al. An automated classification of the structure of protein loops. J Mol Biol. Mar. 7, 1997;266(4):814-30.
Pacouret S, et al. AAV-ID: A Rapid and Robust Assay for Batch-to-Batch Consistency Evaluation of AAV Preparations. Mol Ther. Apr. 17, 2017. Epub ahead of print.
Pagovich OE, et al. Anti-hIgE gene therapy of peanut-induced anaphylaxis in a humanized murine model of peanut allergy. J Allergy Clin Immunol. Dec. 2016;138(6):1652-1662.
Parr MJ, et al. Tumor-selective transgene expression in vivo mediated by an E2F-responsive adenoviral vector. Nat Med. Oct. 1997;3(10):1145-9.
Penaud-Budloo M, et al. Accurate identification and quantification of DNA species by next-generation sequencing in adeno-associated viral vectors produced in insect cells. Hum Gene Ther Methods. May 2, 2017. Epub ahead of print.
Petit L, et al. Rod Outer Segment Development Influences AAV-Mediated Photoreceptor Transduction After Subretinal Injection. Hum Gene Ther. May 16, 2017. Epub ahead of print.
Philiport, et al. Liposomes as tools in Basic Research and Industry. CRC Press, Ann Arbor, Mich. (1995).
Picher-Martel V et al. From Animal Models to Human Disease: A Genetic Approach for Personalized Medicine in ALS. Acta Neuropathol Commun. Jul. 11, 2016;4(1):70.
Pierson EE, et al. Resolving adeno-associated viral particle diversity with charge detection mass spectrometry. Anal Chem. Jul. 2016;88(13):6718-25.
Pillay S, et al. An essential receptor for adeno-associated virus infection. Nature. Feb. 2016;530(7588):108-12.
Pillay S, et al. An essential receptor for adeno-associated virus infection. Nature. Nov. 17, 2016;539(7629):456.
Platt MP, et al. Embryonic disruption of the candidate dyslexia susceptibility gene homolog Kiaa0319-like results in neuronal migration disorders. Neuroscience. Sep. 17, 2013;248:585-93.
Ponder K, et al. Intrathecal injection of lentiviral vector results in high expression in the brain of mucopolysaccharidosis VII dogs but the pattern of expression is different than for AAV9 or AAV-rh10. J Control Release. Dec. 2014, 196:71-8.
Poon MW, et al. Distribution of Kiaa0319-like immunoreactivity in the adult mouse brain—a novel protein encoded by the putative dyslexia susceptibility gene KIAA0319-like. Histol Histopathol. Aug. 2011;26(8):953-63.
Poon MW, et al. Dyslexia-associated kiaa0319-like protein interacts with axon guidance receptor nogo receptor 1. Cell Mol Neurobiol. Jan. 2011;31(1):27-35.
Powell SK et al. Characterization of a novel adeno-associated viral vector with preferential oligodendrocyte tropism. Gene Ther. Sep. 15, 2016.

(56) References Cited

OTHER PUBLICATIONS

Powell SK, et al. Viral expression cassette elements to enhance transgene target specificity and expression in gene therapy. Discov Med. Jan. 2015;19(102):49-57.
Rashnonejad A, et al. Large-Scale Production of Adeno-Associated Viral Vector Serotype-9 Carrying the Human Survival Motor Neuron Gene. Mol Biotechnol. Jan. 2016;58(1):30-6.
Reid CA, et al. miRNA mediated post-transcriptional silencing of transgenes leads to increased adeno-associated viral vector yield and targeting specificity. Gene Ther. Jun. 15, 2017. Epub ahead of print.
Ren XF, et al. Adeno-associated virus-mediated BMP-7 and SOX9 in vitro co-transfection of human degenerative intervertebral disc cells. Genet Mol Res. Apr. 22, 2015;14(2):3736-44.
Rincon MY, et al. Widespread transduction of astrocytes and neurons in the mouse central nervous system after systemic delivery of a self-complementary AAV-PHP.B vector. Gene Ther. Apr. 2018;25(2):83-92.
Robert MA, Nassoury N, Chahal PS, Venne MH, Racine T, Qiu X, Kobinger G, Kamen A, Gilbert R, Gaillet B. Hum Gene Ther. Nov. 27, 2017. [Epub ahead of print].
Rosario AM et al. Microglia-specific Targeting by Novel Capsid-modified AAV6 Vectors. Mol Ther Methods Clin Dev. Apr. 13, 2016;3:16026.
Rothwell, WT, et al. Intrathecal viral vector delivery of trastuzumab prevents or inhibits tumor growth of human HER2-positive xenografts in mice. Cancer Res. Aug. 28, 2018 Epub ahead of print.
Ruffing M, et al. Assembly of viruslike particles by recombinant structural proteins of adeno-associated virus type 2 in insect cells. J Virol. Dec. 1992;66(12):6922-30.
Rutledge EA, et al. Infectious clones and vectors derived from adeno-associated virus (AAV) serotypes other than AAV type 2. J Virol. Jan. 1998;72(1):309-19.
Wang D, et al. Adeno-associated virus vector as a platform for gene therapy delivery. Nat Rev Drug Discov. Feb. 1, 2019. doi: 10.1038/s41573-019-0012-9. [Epub ahead of print] Review.
Qu, Y, et al. Characteristics and advantages of adeno-associated virus vector-mediated gene therapy for neurodegenerative diseases. Neural Regen Res. Jun. 2019;14(6):931-938.
Sevigny J. et al.,The antibody aducanumab reduces Aβ plaques in Alzheimer's disease. Nature. Sep. 1, 2016;537(7618):50-6.
Arndt et al., Structural and kinetic basis for the selectivity of aducanumab for aggregated forms of amyloid-β. Sci Rep. Apr. 23, 2018;8(1):6412.
George et al., An analysis of protein domain linkers: their classification and role in protein folding. Protein Engineering, Design and Selection. Nov. 1, 2002;15(11):871-9.
Kim et al., High cleavage efficiency of a 2A peptide derived from porcine teschovirus-1 in human cell lines, zebrafish and mice. PloS one. 2011;6(4).
Shan e tal., Characterization of scFv-Ig constructs generated from the anti-CD20 mAb 1F5 using linker peptides of varying lengths. The Journal of Immunology. Jun. 1, 1999;162(11):6589-95.
Extended European Search Report dated Mar. 24, 2020 in corresponding European application No. 17790505.6 entitied, "Compositions for the Treatment of Disease".
Deal CE, et al. Engineering humoral immunity as prophylaxis or therapy. Curr Opin Immunol. Aug. 2015;35:113-22.
Deal CE, et al. Vectored antibody gene delivery for the prevention or treatment of HIV infection. Curr Opin HIV AIDS. May 2015;10(3):190-7.
Deng XF, et al. Replication of an autonomous human parvovirus in non-dividing human airway epithelium is facilitated through the DNA damage and repair pathways. PLoS Pathog. Jan. 2016;12(1):e1005399.
Devereux J A comprehensive set of sequence analysis programs for the VAX. Nucleic Acids Res. Jan. 11, 1984;12(1 Pt 1):387-95.
Deverman BE et al. Cre-dependent selection yields AAV variants for widespread gene transfer to the adult brain. Nat Biotechnol. Feb. 2016;34(2):204-9.

Dimidschstein J, et al. A viral strategy for targeting and manipulating interneurons across vertebrate species. Nat Neurosci. Dec. 2016;19(12):1743-1749.
Ding C, et al., Biochemical Characterization of Junonia Coenia Densovirus Nonstructural Protein NS-1. J. Virol., 76 (1):338-345 2002.
Donsante A et al. Intracerebroventricular delivery of self-complementary adeno-associated virus serotype 9 to the adult rat brain. Gene Ther. May 2016;23(5):401-7.
Drouin LM, et al. Cryo-electron microscopy reconstruction and stability studies of Wild-Type and R432A Variant of AAV2 Reveals Capsid Structural Stability is a Major Factor in Genome Packaging. J Virol. Sep. 2016;90(19):8542-51.
Earley LF, et al. Identification and Characterization of Nuclear and Nucleolar Localization Signals in the Adeno-Associated Virus Serotype 2 Assembly-Activating Protein. J Virol. Mar. 2015, 89(6):3038-48.
Earley LF, et al. Adeno-Associated Virus Assembly-Activating Protein Is Not an Essential Requirement for Capsid Assembly of AAV Serotypes 4, 5 and 11. J Virol. Jan. 2017;91(3):pii:e0198-16.
El-Shamayleh Y, et al. Strategies for targeting primate neural circuits with viral vectors. J Neurophysiol. Jul. 2016;116(1):122-34.
Fargnoli AS, et al. Liquid jet delivery method featuring S100A1 gene therapy in the rodent model following acute myocardial infarction. Gene Ther. Feb. 2016;23(2):151-7.
Foust KD, et al. Intravascular AAV9 preferentially targets neonatal neurons and adult astrocytes. Nat Biotechnol. Jan. 2009;27(1):59-65. doi: 10.1038/nbt.1515. Epub Dec. 21, 2008.
Fuchs SP, et al. AAV-Delivered Antibody Mediates Significant Protective Effects against SIVmac239 Challenge in the Absence of Neutralizing Activity. PLoS Pathogens. Aug. 2015;11(8):e1005090.
Fuchs SP, et al. Promise and problems associated with the use of recombinant AAV for the delivery of anti-HIV antibodies. Mol Ther Methods Clin Dev. Nov. 2016;3:16068.
Fuchs SP, et al. Recombinant AAV Vectors for Enhanced Expression of Authentic IgG. PLoS One. Jun. 2016;11(6): e0158009.
G. S. Banker, Modern Pharmaceutics, Drugs and the Pharmaceutical Sciences, v. 72, Marcel Dekker, New York, Inc., 1996.
Gardner MR, et al. AAV-expressed eCD4-Ig provides durable protection from multiple SHIV challenges. Nature. Mar. 2015, 519(7541):87-91.
Gardner MR, et al. Engineering antibody-like inhibitors to prevent and treat HIV-1 infection. Curr Opin HIV AIDS. Feb. 21, 2017. Epub ahead of print.
Gessler DJ et al. Gene Therapy for the Treatment of Neurological Disorders: Metabolic Disorders. Methods Mol Biol. 2016;1382:429-65.
Gilkes JA et al. Preferred Transduction with AAV8 and AAV9 Via Thalamic Administration in the MPS IIIB Model: A Comparison of Four rAAV Serotypes. Mol Genet Metab Rep. Dec. 7, 2015;6:48-54.
Gombash SE, et al. Systemic Gene Therapy for Targeting the CNS. Methods Mol Biol. 2016;1382:231-7.
Gowanlock D, et al. A designer AAV variant permits efficient retrograde access to projection neurons. Neuron. Oct. 19, 2016;92(2):372-382.
Greig JA, et al. Impact of intravenous infusion time on AAV8 vector pharmacokinetics, safety, and liver transduction in cynomolgus macaques. Mol Ther Methods Clin Dev. Dec. 2016;3:16079.
Greig JA, et al. Intramuscular administration of AAV overcomes pre-existing neutralizing antibodies in rhesus macaques. Vaccine. Dec. 2016;34(50):6323-6329.
Gribskov M, et al. Sequence Analysis Primer. M Stockton Press, New York, 1991.
Grieger JC, et al. Production of Recombinant Adeno-associated Virus Vectors Using Suspension HEK293 Cells and Continuous Harvest of Vector From the Culture Media for GMP FIX and FLT1 Clinical Vector. Mol Ther. Feb. 2016;24(2):287-97.
Griffin AM, et al. Computer Analysis of Sequence Data, Part I. Humana Press, New Jersey, 1994.
Grimm D, et al. E Pluribus Unum: 50 years of research, millions of viruses and one goal—tailored acceleration of AAV evolution. Mol Ther. Dec. 2015;23(12):1819-1831.

(56) References Cited

OTHER PUBLICATIONS

Grimm D, et al. Progress in adeno-associated virus type 2 vector production: promises and prospects for clinical use. Hum Gene Ther. Oct. 10, 1999;10(15):2445-50.

Grimson A, et al. MicroRNA targeting specificity in mammals: determinants beyond seed pairing. Mol Cell. Jul. 6, 2007;27(1):91-105.

Gruntman AM, et al. Delivery of Adeno-associated virus gene therapy by intravascular limb infusion methods. Hum Gene Ther Clin Dev Sep. 2015;26(3):159-64.

Gruntman AM, et al. Stability and Compatibility of Recombinant Adeno-Associated Virus Under Conditions Commonly Encountered in Human Gene Therapy Trials. Hum Gene Ther Methods. Apr. 2015, 26(2):71-6.

Gruntman AM, et al. Retro-Orbital Venous Sinus Delivery of rAAV9 Mediates High-Level Transduction of Brain and Retina Compared with Temporal Vein Delivery in Neonatal Mouse Pups. Hum Gene Ther. Mar. 2017;28(3):228-230.

Gurda BL, et al. Evaluation of AAV-mediated gene therapy for central nervous system disease in canine mucopolysaccharidosis VII. Mol Ther. Feb. 2016;24(2):206-16.

Hagg A, et al. Using AAV vectors expressing the beta 2-adrenoceptor or associated G alpha proteins to modulate skeletal muscle mass and muscle fiber size. Sci Rep. Mar. 2016;6:23042.

Hai B, et al. Long-term transduction of miniature pig parotid glands using serotype 2 adeno-associated viral vectors. J Gene Med. Jun. 2009;11(6):506-14.

Halder S, et al. Structure of neurotropic adeno-associated virus AAVrh.8. J Struct Biol. Oct. 2015;192(1):21-36.

Hastie E, et al. Adeno-Associated Virus at 50: A Golden Anniversary of Discovery, Research, and Gene Therapy Success—A Personal Perspective. Hum Gene Ther. May 2015, 26(5):257-65.

Hastie E, et al. Recombinant adeno-associated virus vectors in the treatment of rare diseases. Expert Opin Orphan Drugs. 2015;3(6):675-689.

Hay BA, et al. Vectored gene delivery for lifetime animal contraception: Overview and hurdles to implementation. Theriogenology. May 2018;112:63-74.

Hay CE, et al. Development and testing of AAV-delivered single-chain variable fragments for the treatment of methamphetamine abuse. PLoS ONE. Jun. 29, 2018;13(6):e0200060.

Heim et al., Wavelength mutations and posttranslational autoxidation of green fluorescent protein. Proc. Natl. Acad. Sci. USA (1994).

Heim R, et al. Engineering green fluorescent protein for improved brightness, longer wavelengths and fluorescence resonance energy transfer. Curr Biol. Feb. 1, 1996;6(2):178-82.

Heim R, et al. Improved green fluorescence Nature 373, 663-664 (Feb. 23, 1995); doi:10.1038/373663b0.

Heller KN, et al. Human alpha 7 integrin gene (ITGA7) delivered by adeno-associated virus extends survival of severely affected dystrophin/utrophin deficient mice. Oct. 2015;26(10):647-56.

Hicks MJ, et al. Genetic modification of neurons to express bevacizumab for local anti-angiogenesis treatment of glioblastoma. Cancer Gene Ther. Jan. 2015, 22(1):1-8.

Hicks MJ, et al. Anti-Epidermal Growth Factor Receptor Gene Therapy for Glioblastoma. PLoS One. Oct. 2016;11(10):e0162978.

Hinderer C et al. Delivery of an Adeno-Associated Virus Vector into CSF Attenuates Central Nervous System Disease in Mucopolysaccharidosis Type II Mice. Hum Gene Ther. Aug. 10, 2016.

\* cited by examiner

FIG. 3

Payload Region

1. [Heavy chain | A]
2. [Light chain | A]
3. [Heavy chain | B]
4. [Light chain | B]
5. [Heavy chain | C|B]
6. [Light chain | C|B]
7. [Heavy chain | D]
8. [Light chain | D]
9. [Heavy chain | C|D]
10. [Light chain | C|D]
11. [Light chain | E | Heavy chain]

A – IRES
B – Foot and mouth disease virus
C – Furin cleavage site
D – Porcine Teschovirus-1 Virus
E – 5xG4S ▨ – Heavy chain ▨ – Light chain ical Patent Application No. 62/367,317, entitled COMPOSITIONS FOR THE TREATMENT OF DISEASE, filed Jul. 27, 2016; the contents of each of which are herein incorporated by reference in their entirety.

COMPOSITIONS FOR THE TREATMENT OF DISEASE

CROSS REFERENCE TO RELATED APPLICATIONS

This application is a 35 U.S.C. § 371 U.S. National Stage Entry of International Application No. PCT/US2017/030054 filed Apr. 28, 2017, which claims priority to U.S. Provisional Patent Application No. 62/329,442, entitled COMPOSITIONS FOR THE TREATMENT OF DISEASE, filed Apr. 29, 2016 and U.S. Provisional Patent Application No. 62/367,317, entitled COMPOSITIONS FOR THE TREATMENT OF DISEASE, filed Jul. 27, 2016; the contents of each of which are herein incorporated by reference in their entirety.

REFERENCE TO SEQUENCE LISTING

The instant application contains a Sequence Listing which has been submitted electronically in ASCII format and is hereby incorporated by reference in its entirety. Said ASCII copy, created on Oct. 29, 2018 is named 20571300US371 SL and is 28,642,359 bytes in size.

FIELD OF THE INVENTION

The invention relates to compositions and methods for vectored antibody delivery (VAD).

BACKGROUND OF THE INVENTION

Antibody-based therapies have been developed for a wide variety of diseases, disorders and conditions, including infectious and non-infectious diseases. The U.S. Food and Drug Administration (FDA) has approved antibodies for treatment of cancers, autoimmune and immune system disorders, ocular diseases, nervous system diseases, inflammations, and infections, amongst many others. Naturally, antibodies are components of the adaptive immune response and they function by recognizing specific foreign antigens and stimulating humoral immunity responses. As a consequence, antibodies may be applied to the treatment, prevention, management, diagnosis and research of diseases, disorders and/or conditions.

Antibodies have relatively short half-lives and this presents an ongoing and long-felt challenge for antibody-based therapies. In order to achieve a sufficiently high concentration of an antibody for long lasting therapeutic effects, antibody therapies are traditionally delivered by repeated administration, e.g. by multiple injections. This dosing regimen results in an inconsistent level of antibody throughout the treatment period, limited efficiency per administration, high cost of administration and consumption of the antibody. Hence, there remains a need in the art for delivery of antibodies and antibody-based therapeutics through alternative routes or modalities of administration.

One such alternative route of administration is by expression vector (e.g. plasmid or viral vector), including but not limited to, adeno-associated viral vectors (AAVs). Adeno-associated viral vectors are widely used in gene therapy approaches due to a number of advantageous features. As dependoparvoviruses, AAV are non-replicating in infected cells and therefore not associated with any known disease. Further, AAVs may be introduced to a wide variety of host cells, do not integrate into the genome of the host cell, and are capable of infecting both quiescent and dividing cells. AAVs transduce non-replicating and long-lived cells in vivo, resulting in long term expression of the protein of interest. Further, AAVs can be manipulated with cellular and molecular biology techniques to produce non-toxic particles carrying a payload encoded in the AAV viral genome that can be delivered to a target tissue or set of cells with limited or no side-effects. Given the foregoing, the use of AAVs for vectored antibody delivery (VAD) would allow for longer lasting efficacy, fewer dose treatments, and more consistent levels of the antibody throughout the treatment period.

In vectored antibody delivery (VAD) an AAV is used as the delivery modality for a nucleic acid sequence encoding the antibody, which results in in vivo expression of the encoded payload, e.g., functional antibody.

The mechanism underlying VAD is thought to proceed through the following steps. First the AAV vector enters the cell via endocytosis, then escapes from the endosomal compartment and is transported to the nucleus wherein the viral genome is released and converted into a double-stranded episomal molecule of DNA by the host. The transcriptionally active episome results in the expression of encoded antibodies that may then be secreted from the cell into the circulation. VAD may therefore enable continuous, sustained and long-term delivery of antibodies administered by a single injection of an AAV particle.

Previous studies of an AAV-mediated antibody technique known as vectored immunoprophylaxis (VIP) have focused on neutralization of human immunodeficiency virus (HIV) (see, e.g. Johnson et al., 2009, Nature Med., 15, 901-906, Saunders et al., 2015, J. Virol., 89(16), 8334-8345, Balasz et al., 2012, Nature 481, 81-84, the contents of which are incorporated herein by reference in their entirety). Balasz et al. reported a long-term, even lifelong, expression of monoclonal antibody at high concentration from a single intramuscular administration in mice that resulted in full protection against HIV infection, AAV-mediated VIP has also been demonstrated against influenza strains (see, e.g. Balasz, et al. Nat. Biotechnol., 2013, 31(7):647-52) and *Plasmodium falciparum*, a sporozoite causing malaria infection (see, e.g. Deal at al., 2014, PNAS, 111 (34), 12528-12532), as well as cancer, RSV and drug addiction (see, e.g. review by Schlepp and Johnson, Microbiol. Spectrum 2(4), 2014). Though promising, these studies emphasize efforts to merely prevent disease. There still remains a need for improved methods of prevention, and new antibody-mediated therapies for research, diagnosis, and treatment of disease.

The present invention addresses this need by providing novel AAV particles having viral genomes engineered to encode antibodies and antibody-based compositions and methods of using these constructs (e.g., VAD) for the treatment, prevention, diagnosis and research of diseases, disorders and/or conditions. The present invention further embraces optimized AAV particles for delivery of nucleic acids (e.g., viral genomes) encoding antibodies and antibody-based compositions to a subject in need thereof.

SUMMARY OF THE INVENTION

The invention provides AAV particles comprising a capsid and a viral genome, said viral genome comprising at least one inverted terminal repeat (ITR) region and a payload region, said payload region comprising a regulatory sequence operably linked to at least a first nucleic acid segment, said first nucleic acid segment encoding one or more polypeptides given in Table 3-12, variants and fragments thereof. The capsid of the AAV particle may be any of the serotypes described herein and/or described in Table 1.

In one aspect, the first nucleic acid segment may encode one or more polypeptides such as, but not limited to, an antibody heavy chain, an antibody light chain, a linker, and combinations thereof. The first nucleic acid segment may encode one or more polypeptides which is humanized. As a non-limiting example, the first nucleic acid segment encodes from 5' to 3', an antibody heavy chain, a linker, and an antibody light chain. As another non-limiting example, the first nucleic acid segment encodes from 5' to 3', an antibody light chain, a linker, and an antibody heavy chain. As yet another non-limiting example, the first nucleic acid segment encodes one or more antibody heavy chains. As yet another non-limiting example, the first nucleic acid segment encodes one or more antibody light chains.

In one aspect, the first nucleic acid segment encodes an antibody, having at least 95% identity to any of the sequences of Table 3-12, including, SEQ ID NO: 2948-17938

In one aspect, the regulatory sequence may comprise a promoter such as but not limited to, human elongation factor 1α-subunit (EF1α), cytomegalovims (CMV) immediate-early enhancer and/or promoter, chicken β-actin (CBA) and its derivative CAG, β glucuronidase (GUSB), or ubiquitin C (UBC). Tissue-specific expression elements can be used to restrict expression to certain cell types such as, but not limited to, muscle specific promoters, B cell promoters, monocyte promoters, leukocyte promoters, macrophage promoters, pancreatic acinar cell promoters, endothelial cell promoters, lung tissue promoters, astrocyte promoters, or nervous system promoters which can be used to restrict expression to neurons, astrocytes, or oligodendrocytes.

In one aspect, the linker in the viral genome is selected from one or more of the linkers given in Table 2.

In one aspect, the AAV particles described herein may comprise a viral genome which is single stranded.

In one aspect, the AAV particles described herein may comprise a viral genome which is self-complementary.

In one aspect, the AAV particles described herein may comprise a viral genome comprising at least one intron sequence.

In one aspect, the AAV particles described herein may comprise a viral genome comprising at least one staffer sequence to adjust the length of the viral genome to increase efficacy and/or efficiency.

In one aspect, the AAV particles described herein may comprise at least one region which has been codon optimized. As a non-limiting example, the viral genome may be codon optimized. As another non-limiting example, the first nucleic acid segment is codon-optimized.

In one aspect, the AAV particles described herein may comprise a viral genome with 2 ITR regions. At least one of the ITR regions may be derived from the same or different parental serotype of the capsid. As a non-limiting example, at least one ITR region is derived from AAV2.

In one aspect, the AAV particles comprise a viral genome which comprises a second nucleic acid segment. The second nucleic acid segment may encode an aptamer, siRNA, saRNA, ribozyme, microRNA, mRNA or combination thereof.

In one aspect, the AAV particles comprise a viral genome which comprises a second nucleic acid segment encoding an siRNA designed to target the mRNA that encodes the target of the antibody encoded by the first nucleic acid segment.

In one aspect, the AAV particles comprise a viral genome which comprises a second nucleic acid segment encoding a microRNA, the microRNA is selected to target the mRNA that encodes the target of the antibody encoded by the first nucleic acid segment.

In one aspect, the AAV particles comprise a viral genome which comprises a second nucleic acid segment encoding an mRNA, the mRNA encodes one or more peptides inhibitors of the same target of the antibody encoded by the first nucleic acid segment.

In one aspect, the AAV particles comprise a viral genome which comprises a third nucleic acid segment. The third nucleic acid segment may encode a nuclear export signal, a polynucleotide or polypeptide which acts as a regulator of expression of the viral genome in which it is encoded, a polynucleotide or polypeptide which acts as a regulator of expression of the payload region of the viral genome in which it is encoded and/or a polynucleotide or polypeptide which acts as a regulator of expression of the first nucleic acid segment of the payload region of the viral genome in which it is encoded.

The invention provides AAV particles comprising a capsid and a viral genome, said viral genome comprising at least one inverted terminal repeat (ITR) region and a payload region comprising a regulatory sequence operably linked to at least a first nucleic acid segment, the first nucleic acid segment encoding a bispecific antibody derived from any of the sequences listed in Table 3-12 or portions or fragments thereof.

The invention provides methods of producing a functional antibody in a subject in need thereof, comprising administering to a subject the AAV particles described herein. The level or amount of the functional antibody in the target cell or tissue after administration to the subject may be from about 0.001 ug/mL to 100 mg/mL. The functional antibody may be encoded by a single first nucleic acid segment of a viral genome within the AAV particle. The functional antibody may be encoded by two different viral genomes, the two different viral genomes may be packaged in separate capsids.

The invention provides a pharmaceutical composition comprising an AAV particle described herein in a pharmaceutically acceptable excipient. As a non-limiting example, the pharmaceutically acceptable excipient is saline. As a non-limiting example, the pharmaceutically acceptable excipient is 0.001% pluronic in saline.

The invention provides methods of producing a functional antibody in a subject in need thereof, comprising administering to a subject the AAV particles described herein by a delivery route such as, but not limited to, enteral (into the intestine), gastroenteral epidural (into the dura mater), oral (by way of the mouth), transdermal intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intra-arterial (into an artery), intramuscular (into a muscle), intracardiac (into the heart), intraosseous infusion (into the bone marrow), intrathecal (into the spinal canal), intraparenchymal (into brain tissue), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmicosal (diffusion through a mucous membrane), transvaginal, insufflation (snorting), sublingual, sublabial, enema, eye drops (onto the conjunctiva), or in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebeliornedularis), intracorneal (within the cornea), dental intracoronal, intracoronary (within the coronary arteries), intracorporus cavernosum (within the dilatable spaces of the corporis cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intrailenal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the auras media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), relrobulbar (behind the pons or behind the eyeball), soft tissue, subarachnoid, subconjundival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

The invention provides, methods of treating and/or preventing a disease or disorder in a subject comprising administering to the subject an AAV particle described herein. The administration may be at a prophylactically effective dose such as, but not limited to, from about ug/mL to about 500 ug/mL of expressed polypeptide or 1×10e4 to 1×10e16 VG/mL from the pharmaceutical composition. The pharmaceutical composition may be administered at least once. The pharmaceutical composition may be administered daily, weekly, monthly or yearly. The pharmaceutical composition may be co-administered as part of a combination therapy.

The invention provides methods of producing an antibody in a subject by administering the AAV particles described herein, where the antibody is not a virus neutralizing antibody.

The invention provides methods of producing an antibody in a subject by administering the AAV particles described herein, where the antibody is not an HIV or HCV virus neutralizing antibody.

BRIEF DESCRIPTION OF THE DRAWINGS

The foregoing and other objects, features and advantages will be apparent from the following description of particular embodiments of the invention, as illustrated in the accompanying drawings. The drawings are not necessarily to scale, emphasis instead being placed upon illustrating the principles of various embodiments of the invention.

FIG. 3 is a schematic of payload regions. FIG. 3 discloses "5×G4S" as SEQ ID NO: 17939)

DETAILED DESCRIPTION OF THE INVENTION

I. Compositions of the Invention

Figure 1:
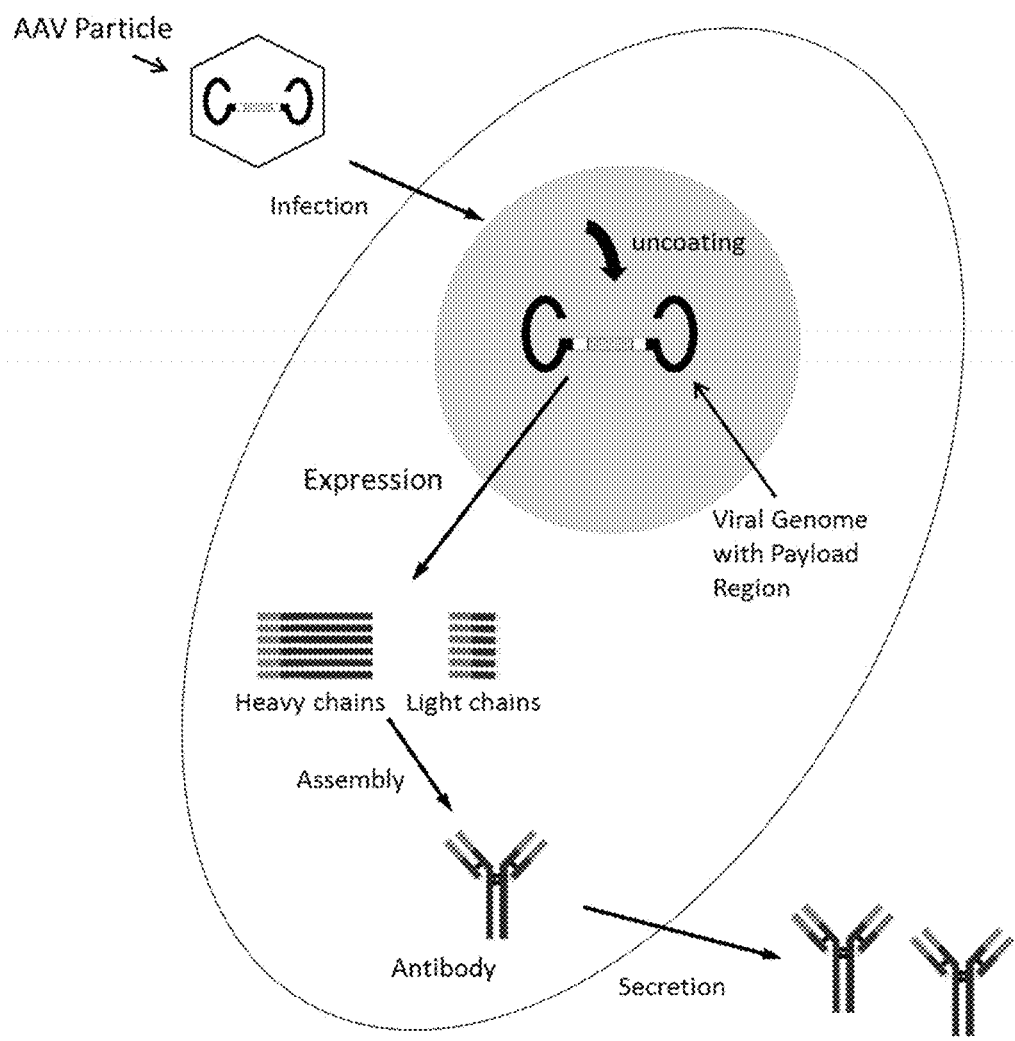
FIG. 1 is a schematic of vectored antibody delivery.

According to the present invention, compositions for delivering functional antibodies and/or antibody-based compositions by adeno-associated viruses (AAVs) are provided. AAV particles of the invention may be provided via any of several routes of administration, to a cell, tissue, organ, or organism, in vivo, ex vivo or in vitro.

As used herein, an "AAV particle" is a virus which comprises a viral genome with at least one payload region and at least one inverted terminal repeat (ITR) region.

As used herein, "viral genome" or "vector genome" refers to the nucleic acid sequence(s) encapsulated in an AAV particle. Viral genomes comprise at least one payload. region encoding polypeptides of the invention, antibodies, antibody-based compositions or fragments thereof.

As used herein, a "payload" or "payload region" is any nucleic acid molecule which encodes one or more polypeptides of the invention. At a minimum, a payload region comprises nucleic acid sequences that encode an antibody, an antibody-based composition, or a fragment thereof, but may also optionally comprise one or more functional or regulatory elements to facilitate transcriptional expression and/or polypeptide translation.

The nucleic acid sequences and polypeptides disclosed herein may be engineered to contain modular elements and/or sequence motifs assembled to enable expression of the antibodies or antibody-based compositions of the invention. In some embodiments, the nucleic acid sequence comprising the payload region may comprise one or more of a promoter region, an intron, a Kozak sequence, an enhancer or a polyadenylation sequence. Payload regions of the invention typically encode antibodies or antibody based compositions, which may include an antibody heavy chain domain, an antibody light chain domain, both antibody heavy and light chain domains, or fragments of the foregoing in combination with each other or in combination with other polypeptide moieties. In some cases, payload regions may also encode one or more linkers or joining regions between antibody heavy and light chain domains or fragments. The order of expression, structural position, or concatamer count (heavy chain, light chain, or linker) may be different within or among different payload regions. The identity, position and number of linkers expressed by payload regions may also vary.

The payload regions of the invention may be delivered to one or more target cells, tissues, organs or organisms within the viral genome of an AAV particle.

Adeno-Associated Viruses (AAVs) and AAV Particles

Viruses of the Parvoviridae family are small non-enveloped icosahedral capsid viruses characterized by a single stranded DNA genome. Parvoviridae family viruses consist of two subfamilies: Parvovirinae, which infect vertebrates, and Densovirinae, which infect invertebrates. Due to its relatively simple structure, easily manipulated using standard molecular biology techniques, this virus family is useful as a biological tool. The genome of the virus may be modified to contain a minimum of components for the assembly of a functional recombinant virus, or viral particle, which is loaded with or engineered to express or deliver a desired payload, which may be delivered to a target cell, tissue, organ, or organism.

The parvoviruses and other members of the Parvoviridae family are generally described in Kenneth I. Berns, "Parvoviridae: The Viruses and Their Replication," Chapter 69 in FIELDS VIROLOGY (3d Ed. 19963, the contents of which are incorporated by reference in their entirety.

The Parvoviridae family comprises the *Dependovirus* genus which includes adeno-associated viruses (AAV) capable of replication in vertebrate hosts including, but not limited to, human primate, bovine, canine, equine, and ovine species.

The AAV vector genonie is a linear, single-stranded DNA (ssDNA) molecule approximately 5,000 nucleotides (nt) in length. The AAV viral genome can comprise a payload region and at least one inverted terminal repeat (ITR) or ITR region. ITRs traditionally flank the coding nucleotide sequences for the non-structural proteins (encoded by Rep genes) and the structural proteins (encoded by capsid genes or Cap genes). While not wishing to be bound by theory, an AAV viral genome typically comprises two ITR sequences. The AAV vector genome comprises a characteristic T-shaped hairpin structure defined by the self-complementary terminal 145 nt of the 5' and 3' ends of the ssDNA which form an energetically stable double stranded region. The double stranded hairpin structures comprise multiple functions including, but not limited to, acting as an origin for DNA replication by functioning as primers for the endogenous DNA polymerase complex of the host viral replication cell.

In addition to the encoded heterologous payload, AAV vectors may comprise the viral genome, in whole or in part, of any naturally occurring and/or recombinant AAV serotype nucleotide sequence or variant. AAV variants may have sequences of significant homology at the nucleic acid (genome or capsid) and amino acid levels (capsids), to produce constructs which are generally physical and functional equivalents, replicate by similar mechanisms, and assemble by similar mechanisms. Chiorini et al., J. Vir. 71: 6823433 (1997); Srivastava et al., J. Vir. 45:555-64 (1983); Chiorini et al. J. Vir. 73:13094319 (1999); Rutledge et al., J. Vir. 72:309-319 (1998); and Wu et al., J. Vir. 74: 863547 (2000), the contents of each of which are incorporated herein by reference in their entirety.

In one embodiment, AAV particles of the present invention are recombinant AAV viral vectors which are replication defective, lacking sequences encoding functional Rep and Cap proteins within their viral genome. These defective AAV vectors may lack most or all parental coding sequences and essentially carry only one or two AAV ITR sequences and the nucleic acid of interest for delivery to a cell, a tissue, an organ or an organism.

In one embodiment, the viral genonie of the AAV particles of the present invention comprise at least one control element which provides for the replication, transcription and translation of a coding sequence encoded therein. Not all of the control elements need always be present as long as the coding sequence is capable of being replicated, transcribed and/or translated in an appropriate host cell. Non-limiting examples of expression control elements include sequences for transcription initiation and/or termination, promoter and/or enhancer sequences, efficient RNA processing signals such as splicing and polyadenylation signals, sequences that stabilize cytoplasmic mRNA, sequences that enhance translation efficacy (e.g., Kozak consensus sequence), sequences that enhance protein stability, and/or sequences that enhance protein processing and/or secretion.

According to the present invention, AAV particles for use in therapeutics and/or diagnostics comprise a virus that has been distilled or reduced to the minimum components necessary for transduction of a nucleic acid payload or cargo of interest. In this manner, AAV particles are engineered as vehicles for specific delivery while lacking the deleterious replication and/or integration features found in wild-type viruses.

AAV vectors of the present invention may be produced recombinantly and may be based on adeno-associated virus (AAV) parent or reference sequences. As used herein, a "vector" is any molecule or moiety which transports, transduces or otherwise acts as a carrier of a heterologous molecule such as the nucleic acids described herein.

In addition to single stranded AAV viral genomes (e.g., ssAAVs), the present invention also provides for self-complementary AAV (scAAVs) viral genomes. scAAV vector genomes contain DNA strands which anneal together to form double stranded DNA. By skipping second strand synthesis, scAAVs allow for rapid expression in the cell.

In one embodiment, the AAV particle of the present invention is an scAAV.

In one embodiment, the AAV particle of the present invention is an ssAAV.

Methods for producing and/or modifying AAV particles are disclosed in the art such as pseudotyped AAV vectors (PCT Patent Publication Nos. WO200028004; WO200123001; WO2004112727; WO 2005005610 and WO 2005072364, the content of each of which is incorporated herein by reference in its entirety).

AAV particles may be modified to enhance the efficiency of delivery. Such modified AAV particles can be packaged efficiently and be used to successfully infect the target cells at high frequency and with minimal toxicity. In some embodiments, the capsids of the AAV particles are engineered according to the methods described in US Publication Number US 20130195801, the contents of which are incorporated herein by reference in their entirety.

In one embodiment, the AAV particles comprising a payload region encoding the polypeptides of the invention may be introduced into mammalian cells.

AAV Serotypes

AAV particles of the present invention comprise or be derived from any natural or recombinant AAV serotype. According to the present invention, the AAV particles may utilize or be based on a serotype selected from any of the following AAV1, AAV2, AAV2G9, AAV3, AAV3a, AAV3b, AAV3-3, AAV4, AAV4-4, AAV5, AAV6, AAV6.1, AAV6.2, AAV6.1.2, AAV7, AAV7.2, AAV8, AAV9, AAV9.11, AAV9.13, AAV9.16, AAV9.24, AAV9.4.5, AAV9.47, AAV9.61, AAV9.68, AAV9.84, AAV9.9, AAV10, AAV11, AAV 12, AAV16.3, AAV24.1, AAV27.3, AAV42.12, AAV42-1b, AAV42-2, AAV42-3a, AAV42-3b, AAV42-4, AAV42-5a, AAV42-5b, AAV42-6b, AAV42-8, AAV42-10, AAV42-11, AAV42-12, AAV42-13, AAV 42.15, AAV42-aa, AAV43-1, AAV43-12, AAV43-20, AAV43-21, AAV43-23, AAV43-25, AAV43-5, AAV44.1, AAV44.2, AAV44.5, AAV223.1, AAV223.2, AAV223.4, AAV223.5, AAV223.6, AAV223.7, AAV1-7/rh.48, AAV1-8/rh.49, AAV2-15/rh.62, AAV2-3/rh.61, AAV2-4/rh.50, AAV2-5/rh.51, AAV3.1/hu.6, AAV3.1/hu.9, AAV3-9/rh.52, AAV3-11/rh.53, AAV4-8/r11.64, AAV4-9/rh.54, AAV4-19/rh.55, AAV5-3/rh.57, AAV5-22/rh.58, AAV7.3/hu.7, AAV16.8/hu.10, AAV16.12/hu.11, AAV29.3/bb.1, AAV29.5/bb.2, AAV106.1/hu.37, AAV114.3/hu.40, AAV127.2/hu.41, AAV127.5/hu.42, AAV128.3/hu.44, AAV130.4/hu.48, AAV145.1/hu.53, AAV145.5/hu.54, AAV145.6/hu.55, AAV161.10/hu.60, AAV161.6/hu.61, AAV33.12/hu.17, AAV33.4/hu.15, AAV33.8/hu.16, AAV52/hu.19, AAV52.1./hu.20, AAV58.2/hu.25, AAVA3.3, AAVA3.4, AAVA3.5, AAVA3.7, AAVC1, AAVC2, AAVC5, AAV-DJ, AAV-DJ8, AAVF3, AAVF5, AAVH2, AAVrh.72, AAVrh.8, AAVrh.68, AAVrh.70, AAVpi.1, AAVpi.3, AAVpi.2, AAVrh.60, AAVrh.44, AAVrh.65, AAVrh.55, AAVrh.47, AAVrh.69, AAVrh.45, AAVrh.59, AAVhu.12, AAVH6, AAVLK03, AAVH-1/hu.1, AAVH-5/hu.3, AAVLG-10/rh.40, AAVLG-4/rh.38, AAVLG-9/hu.39, AAVN721-8/rh.43, AAVCh.5, AAVCh.5R1, AAVcy.2, AAVcy.3, AAVcy.4, AAVcy.5, AAVCy.5R1, AAVCy.5R2, AANCy.5R3, AAVCy.5R4, AAVcy.6, AAVhu.1, AAVhu. 2, AAVhu.3, AAVhu.4, AAVhu.5, AAVhu.6, AAVhu.7, AAVhu.9, AAVhu.10, AAVhu.11, AAVhu.13, AAVhu.15, AAVhu.16, AAVhu.17, AAVhu.18, AAVhu. 20, AAVhu. 21, AAVhu.22, AAVhu.23.2, AAVhu.24, AAVhu.25, AAVhu.27, AAVhu.28, AAVhu.29, AAVhu.29R, AAVhu.31, AAVhu.32, AAVhu.34, AAVhu.35, AAVhu.37, AM/hu.39, AAVhu.40, AAVhu.41, AAVhu.42, AAVhu.43, AAVhu.44, AAVhu.44R1, AAVhu.44R2. AAVhu.44R3, AAVhu.45, AAVhu.46, AAVhu.47, AAVhu.48, AAVhu.48R1, AAVhu.48R2, AAVhu.48R3, AAVhu.49, AAVhu.52AAVhu.54, AAVhu.55, AAVhu.56, AAVhu.57, AAVhu.58, AAVhu.60, AAVhu.61, AAVhu.63, AAVhu.64, AAVhu 66, AAVhu.67, AAVhu.14/9, AAVhu.t 19, AAVrh.2, AAVrh.2R, AAVrh.8, AAVrh8R, AAVrh.10, AAVrh.12, AAVrh.13, AAVrh.13, AAVrh.14, AAVrh.17, AAVrh.18, AAVrh.19, AAVrh.20, AAVrh.21, AAVrh.22, AAVrh.23, AAVrh.24, AAVrh.25, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.46, AAVrh.48, AACrh.48.1, AAVrh.48.1.2, AAVrh.48, 2AAVrh.49, AAVrh.51, AAVrh.52, AAVrh.53, AAVM.54, AAVrh.56, AAVrh.57, AAVrh.58, AAVrh.61, AAVrh.64, AAVrh.64R1, AAVrh.64R2, AAVrh.67, AAVrh.73, AAVrh.74, AAVrh8R, AAVrh8R A586R mutant, AAVrh8R, R533A mutant, AAAV, BAAV, caprine AAV, bovine AAV, AAVhE1.1, AAVhEr1.5, AAVhER1.14, AAVhEr1.8, AAVhEr1.16, AAVhEr1.18, AAVhEr1.35, AAVhEr1.7, AAVhEr1.36, AAVhEr2.29, AAVhEr2.4, AAVhEr2.16, AAVhEr2.30, AAVhEr2.31, AAVhEr2.36, AAVhER1.23, AAVhEr3.1, AAV2.5T, AAV-PAEC, AAV-LK01, AAV-LK02, AAV-LK03, AAV-LK04, AAV-LK05, AAV-LK06, AAV-LK07, AAV-LK08, AAV-LK09, AAV-LK10, AAV-LK11, AAV-LK12, AAV-LK13, AAV-LK14, AAV-LK15, AAV-LK16, AAV-LK17, AAV-LK18, AAV-LK19, AAV-PAEC2, AAV-PAEC4, AAV-PAEC6AAV-PAEC7, AAV-PAEC8, AAV-PAEC11, AAV-PAEC12, AAV-2-pre-miRNA-101, AAV-8h, AAV 8b, AAV-h, AAV-b, AAV SM 10-2, AAV Shuffle 100-1, AAV Shuffle 100-3, AAV Shuffle 100-7, AAV Shuffle 10-2, AAV Shuffle 10-6, AAV Shuffle 10-8, AAV Shuffle 100-2, AAV SM 10-1, AAV SM 108, AAV SM 100-3, AAV SM 100-10, BNP61 AAV, BNP62 AAV, BNP63 AAV, AAVrh.50, AAVrh.43, AAVrh.62, AAVrh.48, AAVhu.19, AAVhu.11, AAVhu.53, AAV4-8/rh.64, AAVLG-9/hu.39, AAV54.5/hu.23, AAV54.2/hu.22, AAV54.7/hu.24, AAV54.1/hu.21, AAV54.4R/hu.27, AAV46.2/hu.28, AAV46.6/hu.29, AAV128.1/hu.43, true type AAV (ttAAV), UPENN AAV 10, Japanese AAV 10 serotypes, AAV CBr-7.1, AAV CBr-7.10, AAV CBr-7.2, AAV CBr-7.3, AAV CBr-7.4, AAV CBr-7.5, AAV CBr-7.7, AAV CBr-7.8, AAV CBr-B7.3, AAV CBr-B7.4, AAV CBr-E1, AAV CBr-E2, AAV CBr-E3, AAV CBr-E4, AAV CBr-E5, AAV CBr-e5, AAV CBr-E6, AAV CBr-E7, AAV CBr-E8, AAV CHt-1, AAV CHt-2, AAV CHt-3, AAV CHt-6.1, AAV CHt-6.10, AAV CHt-6.5, AAV CHt-6.6, AAV CHt-6.7, AAV CHt-6.8, AAV CHt-P1, AAV CHt-P2, AAV CHt-P5, AAV CHt-P6, AAV CHt-P8, AAV CHt-P9, AAV CKd-1, AAV CKd-10, AAV CKd-2, AAV CKd-3, AAV CKd-4, AAV CKd-6, AAV CKd-7, AAV CKd-8, AAV CKd-B1, AAV CKd-B2, AAV CKd-B3, AAV CKd-B4, AAV CKd-B5, AAV CKd-B6, AAV CKd-B7, AAV CKd-B8, AAV CKd-H1, AAV CKd-H2, AAV CKd-H3, AAV CKd-H4, AAV CKd-H5, AAV CKd-H6, AAV CKd-N3, AAV CKd-N4, AAV CKd-N9, AAV CLg-F1, AAV CLg-F2, AAV CLg-F3, AAV CLg-F4, AAV CLg-F5, AAV CLg-F6, AAV CLg-F7, AAV CLg-F8, AAV CLv-1, AAV CLv1-1, AAV Clv1-10, AAV CLv1-2, AAV CLv-12, AAV CLv1-3, AAV CLv-13, AAV CLv1-4, AAV Clv1-7, AAV Clv1-8, AAV Clv1-9, AAV CLv-2, AAV CLv-3, AAV CLv-4, AAV CLv-6, AAV CLv-8, AAV CLb-D1, AAV CLv-D2, AAV CLv-D3, AAV CLv-D4, AAV CLv-D5, AAV CLv-D6, AAV CLv-D7, AAV CLv-D8, AAV CLv-E1, AAV CLv-K1, AAV CLv-K3, AAV CLv-K6, AAV CLv-L4, AAV CLv-L5, AAV CLv-L6, AAV CLv-M1, AAV CLv-M11, AAV CLv-M2, AAV CLv-M5, AAV CLv-M6, AAV CLv-M7, AAV CLv-M8, AAV CLv-M9, AAV CLv-R1, AAV CLv-R2, AAV CLv-R3, AAV CLv-R4, AAV CLv-R5, AAV CLv-R6, AAV CLv-R7, AAV CLv-R8, AAV CLv-R9, AAV CSp-1, AAV CSp-10, AAV CSp-11, AAV CSp-2, AAV CSp-3, AAV CSp-4, AAV CSp-6, AAV CSp-7, AAV CSp-8, AAV CSp-8.10, AAV CSp-8.2, AAV CSp-8.4, AAV CSp-8.5, AAV CSp-8.6, AAV CSp-8.7, AAV CSp-8.8, AAV CSp-8.9, AAV CSp-9, AAV.hu.48R3, AAV.VR-355, AAV3B, AAV4, AAV5, AAVF1/HSC1, AAVF11/HSC11, AAVF12/HSC12, AAVF13/HSC13, AAVF14/HSC14, AAVF15/HSC15, AAVF16/HSC16, AAVF17/HSC17, AAVF2/HSC2, AAVF3/HSC3, AAVF4/HSC4, AAVF5/HSC5, AAVF6/HSC6, AAVF7/HSC7, AAVF8/HSC8, AAVF9/HSC9, PHP.B, PHP.A, G2B-26, G2B-13, TH1.1-32 and/or TH1.1.-35 and variants thereof.

In some embodiments, the AAV serotype may be, or have, a sequence as described in United States Publication No. US20030138772, the contents of which are herein incorporated by reference in their entirety, such as, but not limited to, AAV1 (SEQ ID NO: 6 and 64 of US20030138772) AAV2 (SEQ ID NO: 7 and 70 of US20030138772), AAV3 (SEQ ID NO: 8 and 71 of US20030138772), AAV4 (SEQ ID NO: 63 of US20030138772), AAV5 (SEQ ID NO: 114 of US20030138772), AAV6 (SEQ ID NO: 65 of US20030138772), AAV7 (SEQ ID NO: 1-3 of US20030138772), AAV8 (SEQ ID NO: 4 and 95 of US20030138772), AAV9 (SEQ ID NO: 5 and 100 of US20030138772), AAV10 (SEQ ID NO: 117 of US20030138772) AAV11 (SEQ ID NO: 118 of US20030138772), AAV12 (SEQ ID NO: 119 of US20030138772), AAVrh10 (amino acids 1 to 738 of SEQ ID NO: 81 of US20030138772), AAV16.3 (US20030138772 SEQ ID NO: 10), AAV29.3/bb.1 (US20030138772 SEQ ID NO: 11), AAV29.4 (US20030138772 SEQ ID NO: 12), AAV29.5/bb.2 (US20030138772 SEQ ID NO: 13), AAV1.3 (US20030138772 SEQ ID NO: 14), AAV13.3 (US20030138772 SEQ ID NO: 15), AAV24.1 (US20030138772 SEQ ID NO: 16), AAV27.3 (US20030138772 SEQ ID NO: 17), AAV7.2 (US20030138772 SEQ ID NO: 18), AAVC1 (US20030138772 SEQ ID NO: 19), AAVC3 (US20030138772 SEQ ID NO: 20), AAVC5 (US20030138772 SEQ ID NO: 21), AAVF1 (US20030138772 SEQ ID NO: 22), AAVF3 (US20030138772 SEQ ID NO. 23), AAVF5 (US20030138772 SEQ ID NO: 24). AAVH6 (US20030138772 SEQ ID NO: 25), AAVH2 (US20030138772 SEQ ID NO: 26), AAV42-8 (US20030138772 SEQ ID NO: 27), AAV42-15 (US20030138772 SEQ ID NO: 28), AAV42-5b (US20030138772 SEQ ID NO: 29), AAV42-1b (US20030138772 SEQ ID NO: 30), AAV42-13 (US20030138772 SEQ ID NO: 31), AAV42-3a (US20030138772 SEQ ID NO: 32), AAV42-4 (US20030138772 SEQ ID NO: 33), AAV42-5a (US20030138772 SEQ ID NO: 34), AAV42-10 (US20030138772 SEQ ID NO: 35), AAV42-3b (US20030138772 SEQ ID NO: 36), AAV42-11 (US20030138772 SEQ ID NO: 37), AAV42-6b (US20030138772 SEQ ID NO: 38), AAV43-1 (US20030138772 SEQ ID NO: 39), AAV43-5 (US20030138772 SEQ ID NO: 40), AAV43-12 (US20030138772 SEQ ID NO: 41), AAV43-20 (US20030138772 SEQ ID NO: 42), AAV43-21 (US20030138772 SEQ ID NO: 43), AAV43-23 (US20030138772 SEQ ID NO: 44), AAV43-25 (US20030138772 SEQ ID NO: 45), AAV44.1 (US20030138772 SEQ ID NO: 46), AAV44.5 (US20030138772 SEQ ID NO: 47), AAV223.1 (US20030138772 SEQ ID NO: 48), AAV223.2 (US20030138772 SEQ ID NO: 49), AAV223.4 (US20030138772 SEQ ID NO: 50), AAV223.5 (US20030138772 SEQ ID NO: 51), AAV223.6 (US20030138772 SEQ ID NO: 52), AAV223.7 (US20030138772 SEQ ID NO: 53), AAVA3.4 (US20030138772 SEQ ID NO: 54), AAVA3.5 (US20030138772 SEQ ID NO: 55), AAVA3.7 (US20030138772 SEQ ID NO: 56), AAVA3.3 (US20030138772 SEQ ID NO: 57), AAV42.12 (US20030138772 SEQ ID NO: 58), AAV44.2 (US20030138772 SEQ ID NO: 59), AAV42-2 (US20030138772 SEQ ID NO: 9), or variants thereof.

In some embodiments, the AAV serotype may be, or have, a sequence as described in United States Publication No. US20150159173, the contents of which are herein incorporated by reference in their entirety, such as, but not limited to, AAV2 (SEQ ID NO: 7 and 23 of US20150159173), rh20 (SEQ ID NO: 1 of US20150159173), rh32/33 (SEQ ID NO: 2 of US20150159173), rh39 (SEQ ID NO: 3, 20 and 36 of US20150159173), rh46 (SEQ ID NO: 4 and 22 of US20150159173), rh73 (SEQ ID NO: 5 of US20150159173), rh74 (SEQ ID NO: 6 of US20150159173), AAV6.1 (SEQ ID NO: 29 of US20150159173), rh.8 (SEQ ID NO: 41 of US20150159173), rh.48.1 (SEQ ID NO: 44 of US20150159173), hu.44 (SEQ ID NO: 45 of US20150159173), hu.29 (SEQ ID NO: 42 of US20150159173), hu.48 (SEQ ID NO: 38 of US20150159173), rh54 (SEQ ID NO: 49 of US20150159173), AAV2 (SEQ ID NO: 7 of US20150159173), cy.5 (SEQ ID NO: 8 and 24 of US20150159173), rh.10 (SEQ ID NO: 9 and 25 of US20150159173), rh.13 (SEQ ID NO: 10 and 26 of US20150159173), AAV1 (SEQ ID NO: 11 and 27 of US20150159173), AAV3 (SEQ ID NO: 12 and 28 of US20150159173), AAV6 (SEQ ID NO: 13 and 29 of US20150159173), AAV7 (SEQ IT) NO: 14 and 30 of US20150159173), AAV8 (SEQ ID NO: 15 and 31 of US20150159173), hu.13 (SEQ ID NO: 16 and 32 of US20150159173), hu.26 (SEQ ID NO: 17 and 33 of US20150159173), hu.37 (SEQ ID NO: 18 and 34 of US20150159173), hu.53 (SEQ ID NO: 19 and 35 of US20150159173), rh.43 (SEQ ID NO: 21 and 37 of US20150159173), rh2 (SEQ ID NO: 39 of US20150159173), rh.37 (SEQ FD NO: 40 of US20150159173) rh.64 (SEQ ID NO: 43 of US20150159173) rh.48 (SEQ ID NO: 44 of US20150159173), ch.5 (SEES ID NO 46 of US20150159173), rh.67 (SEQ ID NO: 47 of US20150159173), rh.58 (SEQ ID NO: 48 of US20150159173), or variants thereof including, but not limited to Cy5R1, Cy5R2, Cy5R3, Cv5R4, rh.13R, rh.37R2, rh.2R, rh.8R, rh.48.1, rh.48.2, rh.48.1.2, hu.44R1, hu.44R2, hu.44R3, hu.29R, ch.5R1, rh64R1, rh64R2, AAV6.2, AAV6.1, AAV6.12, hu.48R1, hu.48R2, and hu.48R3.

In some embodiments, the AAV serotype may be, or have, a sequence as described in U.S. Pat. No. 7,198,951, the contents of which are herein incorporated by reference in their entirety, such as, but not limited to, AAV9 (SEQ ID NO: 1-3 of U.S. Pat. No. 7,198,951), AAV2 (SEQ ID NO: 4 of U.S. Pat. No. 7,198,951), AAV1 (SEQ ID NO: 5 of U.S. Pat. No. 7,198,951), AAV3 (SEQ ID NO: 6 of U.S. Pat. No. 7,198,951), and AAV8 (SEQ ID NO: 7 of U.S. Pat. No. 7,198,951.).

In some embodiments, the AAV serotype may be, or have, a mutation in the AAV9 sequence as described by N Pulicherla et al. (Molecular Therapy 19(6):1070-1078 (2011), herein incorporated by reference in its entirety), such as hut not limited to, AAV9.9, AAV9.11, AAV9.13, AAV9.16, AAV9.24, AAV9.45, AAV9.47, AAV9.61, AAV9.68, AAV9.84.

In some embodiments, the AAV serotype may be, or have, a sequence as described in U.S. Pat. No. 6,156,303, the contents of which are herein incorporated by reference in their entirety, such as, but not limited to, AAV3B (SEQ ID NO: 1 and 10 of U.S. Pat. No. 6,156,303), AAV6 (SEQ ID NO: 2, 7 and 11 of U.S. 6,156,303), AAV2 (SEQ ID NO: 3 and 8 of U.S. Pat. No. 6,156,303). AAV3A (SEQ ID NO: 4 and 9, of U.S. Pat. No. 6,156,303), or derivatives thereof.

In some embodiments, the AAV serotype may be, or have, a sequence as described in United States Publication No. US20140359799, the contents of which are herein incorporated by reference in their entirety, such as, but not limited to, AAV8 (SEQ ID NO: 1 of US20140359799), AAVDJ (SEQ ID NO: 2 and 3 of US20140359799), or variants thereof.

In some embodiments, the serotype may be AAVDJ or a variant thereof, such as AAVDJ8 (or AAV-DJ8), as described by Grimm et al. (Journal of Virology 82(12): 5887-5911 (2008), herein incorporated by reference in its entirety). The amino acid sequence of AAVDJ8 may comprise two or more mutations in order to remove the heparin binding domain (HBD). As a non-limiting example, the AAV-DJ sequence described as SEQ ID NO: 1 in U.S. Pat. No. 7,588,772, the contents of which are herein incorporated by reference in their entirety, may comprise two mutations: (1) R587Q where arginine (R; Arg) at amino acid 587 is changed to glutamine (Q; Gin) and (2) R590T where arginine (R; Arg) at amino acid 590 is changed to threonine (T; Thr). As another non-limiting example, may comprise three mutations: (1) K406R where lysine (K; Lys) at amino acid 406 is changed to arginine (R; Arg), (2) R587Q where arginine (R; Arg) at amino acid 587 is changed to glutamine (Q; Gin) and (3) R590T where arginine (R; Arg) at amino acid 590 is changed to threonine (T; Thr).

In some embodiments, the AAV serotype may be, or have, a sequence of AAV4 as described in International. Publication No. WO199801.1244, the contents of which are herein incorporated by reference in their entirety, such as, but not limited to AAV4 (SEQ ID NO: 1-20 of WO1998011244).

In some embodiments, the AAV serotype may be, or have, a mutation in the AAV2 sequence to generate AAV2G9 as described in international Publication No. WO2014144229 and herein incorporated by reference in its entirety.

In some embodiments, the AAV serotype may be, or have, a sequence as described in International Publication No. WO2005033321, the contents of which are herein incorporated by reference in their entirety, such as, but not limited to AAV3-3 (SEQ ID NO: 217 of WO2005033321), AAV1 (SEQ ID NO: 219 and 202 of WO2005033321), AAV106.1/hu.37 (SEQ ID No: 10 of WO2005033321), AAV114.3/hu.40 (SEQ ID No: 11 of WO2005033321), AAV127.2/hu.41. (SEQ ID NO:6 and 8 of WO2005033321), AAV128.3/hu.44 (SEQ ID No: 81 of WO2005033321), AAV130.4/hu.48 (SEQ ID NO: 78 of WO2005033321), AAV145.1/hu.53 (SEQ ID No: 176 and 177 of WO2005033321), AAV145.6/hu.56 (SEQ ID NO: 168 and 192 of WO2005033321), AAV16.12/hu.11 (SEQ ID NO: 153 and 57 of WO2005033321), AAV16.8/hu.10 (SEQ ID NO: 156 and 56 of WO2005033321) AAV161.10/hu.60 (SEQ ID No: 170 of WO2005033321), AAV161.61/hu.61 (SEQ ID No: 174 of WO2005033321), AAV1-7/rh.48 (SEC) ID NO: 32 of WO2005033321), AAV1-8/rh.49 (SEQ ID NOs: 103 and 25 of WO2005033321), AAV2 (SEQ ID NO: 211 and 221 of WO2005033321), AAV2-15/rh.62 (SEQ ID No: 33 and 114 of WO2005033321), AAV2-3/rh.61 (SEQ ID NO: 21 of WO2005033321), AAV2-rh.50 (SEQ ID No: 23 and 108 of WO2005033321), AAV 2-5/rh.51 (SEQ ID NO: 104 and 22 of WO2005033321) AAV3.1/hu.6 (SEQ ID NO: 5 and 84 of WO2005033321), AAV3.1/hu.9 (SEQ ID NO: 155 and 58 of WO2005033321), AAV3-11/rh.53 (SEQ ID NO: 186 and 176 of WO2005033321), AAV3-3 (SEQ ID NO: 200 of WO2005033321), AAV33.12/hu.17 (SEQ ID NO:4 of WO2005033321), AAV33.4/hu.15 (SEQ ID No: 50 of WO2005033321), AAV33.8/hu.16 (SEQ ID No: 51 of WO2005033321), AAV3-9/rh.52 (SEQ ID NO: 96 and 18 of WO2005033321), AAV4-19/rh.55 (SEQ ID NO: 117 of WO2005033321), AAV4-4 (SEQ ID NO: 201 and 218 of WO2005033321), AAV4-9/rh.54 (SEQ ID NO: 116 of WO2005033321), AAV5 (SEQ ID NO: 199 and 216 of WO2005033321), AAV52.1/hu.20 (SEQ ID NO: 63 of WO2005033321), AAV52/hu.19 (SEQ ID NO: 133 of WO2005033321), AAV5-22/rh.58 (SEQ ID No: 27 of WO2005031321), AAV5-3/rh.57 (SEQ ID NO: 105 of WO2005033321), AAV5-3/rh.57 (SEQ ID No: 26 of WO2005033321), AAV58.2/hu.25 (SEQ ID No: 49 of WO2005033321), AAV6 (SEQ ID NO: 203 and 220 of WO2005033321), AAV7 (SEQ ID NO: 222 and 213 of WO2005033321), AAV7.3/hu.7 (SEQ ID No: 55 of WO2005033321), AAV8 (SEQ ID NO: 223 and 214 of WO2005033321), AAVH-1/hu.1 (SEQ ID No: 46 of WO2005033321), AAVH-5/hu.3 (SEQ ID No: 44 of WO2005033321), AAVhu.1 (SEQ ID NO: 144 of WO2005033321), AAVhu.10 (SEQ ID NO: 156 of WO2005033321), AAVhu.11 (SEQ ID NO: 153 of WO2005033321), AAVhu.12 (WO2005033321 SEQ ID NO: 59), AAVhu.13 (SEQ ID NO: 129 of WO2005033321), AAVhu.14/AAV9 (SEQ ID NO: 123 and 3 of WO2005033321), AAVhu.15 (SEQ ID NO: 147 of WO2005033321), AAVhu:16 (SEQ ID NO: 148 of WO2005033321), AAVhu.17 (SEQ ID NO: 83 of WO2005033321), AAVhu.18 (SEQ ID NO: 149 of WO2005033321), AAVhu.19 (SEQ ID NO: 133 of WO2005033321), AAVhu.2 (SEQ ID NO: 143 of WO2005033321), AAVhu.20 (SEQ ID NO: 134 of WO2005033321), AAVhu.21 (SEQ ID NO: 135 of WO2005033321), AAVhu.22 (SEQ ID NO: 138 of WO2005033321), AAVhu.23.2 (SEQ ID NO: 137 of WO2005033321), AAVhu.24 (SEQ ID NO: 136 of WO2005033321), AAVhu.25 (SEQ ID NO: 146 of WO2005033321), AAVhu.27 (SEQ ID NO: 140 of WO2005033321), AAVhu.29 (SEQ ID NO: 132 of WO2005033321), AAVhu.3 (SEQ ID NO: 145 of WO2005033321), AAVhu.31 (SEQ ID NO: 121 of WO2005033321), AAVhu.32 (SEQ ID NO: 122 of WO2005033321), AAVhu.34 (SEQ ID NO: 125 of WO2005033321), (SEQ ID NO: 164 of WO2005033321), AAVhu.37 (SEQ ID NO: 88 of WO2005033321), AAVhu.39 (SEQ ID NO: 102 of WO2005033321), AAVhu.4 (SEQ ID NO: 141 of WO2005033321), AAVhu.40 (SEQ ID NO: 87 of WO2005033321), AAVhu.41. (SEQ ID NO: 91 of WO2005033321), AAVhu.42 (SEQ ID NO: 85 of WO2005033321), AAVhu.43 (SEQ ID NO: 160 of WO2005033321), AAVhu.44 (SEQ ID NO: 144 of WO2005033321), AAVhu.43 (SEQ ID NO: 127 of WO2005033321), AAVhu.46 (SEQ ID NO: 159 of WO2005033321), AAVhu.47 (SEQ ID NO: 128 of WO2005033321), AAVhu.48 (SEQ ID NO: 137 of WO2005033321), AAVhu.49 (SEQ ID NO: 189 of WO2005033321), AAVhu.51 (SEQ ID NO: 190 of WO2005033321), AAVhu.52 (SEQ ID NO: 191 of WO2005033321), AAVhu.53 (SEQ ID NO: 186 of WO2005033321), AAVhu.54 (SEQ ID NO: 188 of WO2005033321), AAVhu.55 (SEQ ID NO: 187 of WO2005033321), AAVhu.56 (SEQ ID NO: 192 of WO2005033321), AAVhu.57 (SEQ ID NO: 193 of WO2005033321), AAVhu.58 (SEQ ID NO: 194 of WO2005033321), AAVhu.6 (SEQ ID NO: 84 of WO2005033321), AAVhu.60 (SEQ ID NO: 184 of WO2005033321), AAVhu.61 (SEQ ID NO: 185 of WO2005033321), AAVhu.63 (SEQ ID NO: 195 of WO2005033321), AAVhu.64 (SEQ ID NO: 196 of WO2005033321), AAVhu.66 (SEQ ID NO: 197 of WO2005033321), AAVhu.67 (SEQ ID NO: 198 of WO2005033321), AAVhu.7 (SEQ ID NO: 150 of WO2005033321), AAVhu.8 (WO2005033321 SEQ ID NO: 12), AAVhu.9 (SEQ ID NO: 155 of WO2005033321), AAVLG-10/rh.40 (SEQ ID No: 14 of WO2005033321), AAVLG-4/rh.38 (SEQ ID NO: 86 of WO2005033321), AAVLG-4/rh.38 (SEQ ID No: 7 of WO2005033321), AAVN721-8/rh.43 (SEQ ID NO: 163 of WO2005033321), AAVN721-8/rh.43 (SEQ ID No: 43 of WO2005033321), AAVpi.1 (WO2005033321 SEQ ID NO: 28), AAVpi.2 (WO2005033321 SEQ ID NO: 30), AAVpi.3 (WO2005033321 SEQ ID NO: 29), AAVrh.38 (SEQ ID NO: 86 of WO2005033321), AAVrh.40 (SEQ ID NO: 92 of WO2005033321), AAVrh.43 (SEQ ID NO: 163 of WO2005033321), AAVrh.44 (WO2005033321 SEQ ID NO: 34), AAVrh.45 (WO2005033321 SEQ ID NO: 41), AAVrh.47 (WO2005033321 SEQ ID NO: 38), AAVrh.48 (SEQ ID NO: 115 of WO2005033321), AAVrh.49 (SEQ ID NO: 103 of WO2005033321), AAVrh.50 (SEQ ID NO: 108 of WO2005033321), AAVrh.51 (SEQ ID NO: 104 of WO2005033321), AAVrh.52 (SEQ ID NO: 96 of WO2005033321), AAVrh.53 (SEQ ID NO: 97 of WO2005033321), AAVrh.55 (WO2005033321 SEQ ID NO: 37), AAVrh.56 (SEQ ID NO: 152 of WO2005033321), AAVrh.57 (SEQ ID NO: 105 of WO2005033321), AAVrh.58 (SEQ ID NO: 106 of WO2005033321), AAVrh.59 (WO2005033321 SEQ ID NO: 42), AAVrh.60 (WO2005033321 SEQ ID NO: 31), AAVrh.61 (SEQ ID NO: 107 of WO2005033321), AAVrh.62 (SEQ ID NO: 114 of WO2005033321), AAVrh.64 (SEQ ID NO: 99 of WO2005033321), AAVrh.65 (WO2005033321 SEQ ID NO: 35), AAVrh.68 (WO2005033321 SEQ ID NO: 16), AAVrh.69 (WO2005033321 SEQ ID NO: 39), AAVrh.70 (WO2005033321 SEQ ID NO: 20), AAVrh.72 (WO2005033321 SEQ ID NO: 9), or variants thereof including, but not limited to, AAVcy.2, AAVcy.3, AAVcy.4, AAVcy:5, AAVcy.6AAVrh.12AAVrh.17, AAVrh.18, AAVrh.19, AAVrh.21, AAVrh.22, AAVrh.23, AAVrh.24, AAVrh.25, AAVM.25/42 15, AAVrh.31, AAVrh.32, AAVrh.33, AAVrh.34, AAVrh.35, AAVrh.36, AAVrh.37, AAVrh14. Non-limiting examples of variants include SEQ ID NO: 13, 15, 17, 19, 24, 36, 40, 45, 47, 48, 51-54, 60-62, 64-77, 79, 80, 82, 89, 90, 93-95, 98, 100, 101, 109-113, 118-120, 124, 126, 131, 139, 142, 151,154, 158, 161, 162, 165-183, 202, 204-212, 215, 219, 224-236, of WO2005033321, the contents of which are herein incorporated by reference in their entirety.

In some embodiments, the AAV serotype may be, or have, a sequence as described in International Publication No. WO2015168666, the contents of which are herein incorporated by reference in their entirety, such as, but not limited to, AAVrh8R (SEQ ID NO: 9 of WO2015168666), AAVrh8R A586R mutant (SEQ ID NO: 10 of WO2015168666), AAVrh8R R533A mutant (SEQ ID NO: 11 of WO2015168666), or variants thereof.

In some embodiments, the AAV serotype may be, or have, a sequence as described in U.S. Pat. No. 9,233,131, the contents of which are herein incorporated by reference in their entirety, such as, but not limited to, AAVhE1.1 (SEQ ID NO:44 of U.S. Pat. No. 9,233,131), AAVhEr1.5 (SEQ ID NO:45 of U.S. Pat. No. 9,233,131), AAVhER1.14 (SEQ ID NO:46 of U.S. Pat. No. 9,233,131), AAVhEr1.8 (SEQ ID NO:47 of U.S. Pat. No. 9,233,131), AAVhEr1.16 (SEQ ID NO:48 of U.S. Pat. No. 9,233,131), AAVhEr1.18 (SEQ ID NO:49 of U.S. Pat. No. 9,233,131), AAVhEr1.35 (SEQ ID NO:50 of U.S. Pat. No. 9,233,131), AAVhEr1.7 (SEQ ID NO:51 of U.S. Pat. No. 9,233,131), AAVhEr1.36 (SEQ ID NO:52 of U.S. Pat. No. 9,233,131), AAVhEr2.29 (SEQ ID NO:53 of U.S. Pat. No. 9,233,131), AAVhEr2.4 (SEQ ID NO:54 of U.S. Pat. No. 9,233,131), AAVhEr2.16 (SEQ ID NO:5.5 of U.S. Pat. No. 9,233,131), AAVhEr2.30 (SEQ ID NO: 56 of U.S. Pat. No. 9,233,131), AAVhEr2.31 (SEQ ID NO:58 of U.S. Pat. No. 9,233,131), AAVhEr2.36 (SEQ ID NO:57 of U.S. Pat. No. 9,233,131), AAVhER1.23 (SEQ ID NO:53 of U.S. Pat. No. 9,233,131), AAVhEr3.1 (SEQ ID NO:59 of U.S. Pat. No. 9,233,131), AAV2.5T (SEQ ID NO:42 of U.S. Pat. No. 9,233,131), or variants thereof.

In some embodiments, the AAV serotype may be, or have, a sequence as described in United. States Patent Publication No, US20150376607, the contents of which are herein incorporated by reference in their entirety, such as, but not limited to, AAV-PAEC (SEQ ID NO:1 of US20150376607), AAV-LK01 (SEQ ID NO:2 of US20150376607), AAV-LK02 (SEQ ID NO:3 of US20150376607), AAV-LK,03 (SEQ ID NO:4 of US20150376607), AAV-LK04 (SEQ ID NO:5 of US20150376607), AAV-LK05 (SEQ ID NO:6 of US20150376607), AAV-LK06 (SEQ ID NO:7 of US20150376607), AAV-LK07 (SEQ ID NO:8 of US20150376607), AAV-LK08 (SEQ ID NO:9 of US20150376607), (SEQ ID NO:10 of US20150376607), AAV-LK10 (SEQ ID NO:11 of US20150376607), AAV-LK11 (SEQ ID NO:12 of US20150376607), AAV-LK12 (SEQ ID NO:13 of US20150376607), AAV-LK13 (SEQ ID NO:14 of US20150376607), AAV-LK14 (SEQ ID NO:15 of US20150376607), AAV-LK15 (SEQ ID NO:16 of US20150376607), AAV-LK16 (SEQ ID NO:17 of US20150376607), AAV-LK17 (SEQ ID NO:18 of US20150376607), AAV-LK18 (SEQ ID NO:19 of US20150376607), AAV-LK19 (SEQ ID NO: 20 of US20150376607), AAV-PAEC2 (SEQ ID NO:21 of US20150376607), AAV-PAEC4 (SEQ ID NO:22 of US20150376607), AAV-PAEC6 (SEQ ID NO:23 of US20150376607), AAV-PAEC7 (SEQ ID NO:24 of US20150376607), AAV-PAEC8 (SEQ ID NO:25 of US20150376607), AAV-PAEC11 (SEQ ID NO:26 of US20150376607), AAV-PAEC12 (SEQ ID NO:27, of US20150376607) or variants thereof.

In some embodiments, the AAV serotype may be, or have, a sequence as described in U.S. Pat. No. 9,163,261, the contents of which are herein incorporated by reference in their entirety, such as, but not limited to, AAV-2-pre-miRNA-101 (SEQ ID NO: 1 U.S. Pat. No. 9,163,261), or variants thereof.

In some embodiments, the AAV serotype may be, or have, a sequence as described in United States Patent Publication No. US20150376240, the contents of which are herein incorporated by reference in their entirety, such as, but not limited to, AAV-8h (SEQ NO: 6 of US20150376240), AAV-8b (SEQ ID NO: 5 of US20150376240), AAV-h (SEQ ID NO: 2 of US20150376240), AAV-b (SEQ ID NO: 1 of US20150376240), or variants thereof.

In some embodiments, the AAV serotype may be, or have, a sequence as described in United States Patent Publication No. US20160017295, the contents of which are herein incorporated by reference in their entirety, such as, but not limited to, AAV SM 10-2 (SEQ ID NO: 22 of US20160017295), AAV Shuffle 100-1 (SEQ ID NO: 23 of US20160017295), AAV Shuffle 100-3 (SEQ ID NO: 24 of US20160017295), AAV Shuffle 100-7 (SEQ ID NO: 25 of US20160017295), AAV Shuffle 10-2 (SEQ ID NO: 34 of US20160017295), AAV Shuffle 10-6 (SEQ ID NO: 35 of US20160017295), AAV Shuffle 10-8 (SEQ ID NO: 36 of US20160017295), AAV Shuffle 100-2 (SEQ ID NO: 37 US20160017295), AAV SM 10-1 (SEQ ID NO: 38 of US20160017295), AAV SM 10-8 (SEQ ID NO: 39 of US20160017295), AAV SM 100-3 (SEQ ID NO: 40 of US20160017295), AAV SM 100-10 (SEQ ID NO: 41 of US20160017295), or variants thereof.

In some embodiments, the AAV serotype may be, or have, a sequence as described in United States Patent Publication No. US20150238550, the contents of which are herein incorporated by reference in their entirety, such as, but not limited to, BNP61 AAV (SEQ ID NO: 1 of US20150238550), BNP62 AAV (SEQ ID NO: 3 of US20150238550), BNP63 AAV (SEQ ID NO: 4 of US20150238550), or variants thereof.

In some embodiments, the AAV serotype may be or may have a sequence as described in United States Patent Publication No. US20150315612, the contents of which are herein incorporated by reference in their entirety, such as, but not limited to, AAVrh.50 (SEQ ID NO: 108 of US20150315612), AAVrh.43 (SEQ ID NO: 163 of US20150315612), AAVrh.62 (SEQ ID NO: 114 of US20150315612), AAVrh.48 (SEQ ID NO: 115 of US20150315612), AAVhu.19 (SEQ ID NO: 133 of US20150315612), AAVhu.11 (SEQ ID NO: 1.53 of US20150315612), AAVhu.53 (SEQ ID NO: 186 of US20150315612), AAV4-8/rh.64 (SEQ ID No: 15 of US20150315612), AAVLG-9/hu.39 (SEQ ID No: 24 of US20150315612), AAV54.5/hu.23 (SEQ ID No: 60 of US20150315612), AAV54.2/hu.22 (SEQ ID No: 67 of US20150315612), AAV54.7/hu.24 (SEQ ID No: 66 of US20150315612), AAV54.1/hu.21 (SEQ ID No: 65 of US20150315612), AAV54.4R/hu.27 (SEQ ID No: 64 of US20150315612), AAV46.2/hu.28 (SEQ ID No: 68 of US20150315612), AAV46.6/hu.29 (SEQ ID No: 69 of US20150315612), AAV128.1/hu.43 (SEQ ID No: 80 of US20150315612), or variants thereof.

In some embodiments, the AAV serotype may be, or have, a sequence as described in International Publication No. WO2015121501, the contents of which are herein incorporated by reference in their entirety, such as, but not limited to, true type AAV (ttAAV) (SEQ ID NO: 2 of WO2015121501), "UPenn AAV10" (SEQ ID NO: 8 of WO2015121501), "Japanese AAV10" (SEQ ID NO: 9 of WO2015121501), or variants thereof.

According to the present invention AAV capsid serotype selection or use may be from a variety of species. In one embodiment, the AAV may be an avian AAV (AAAV). The AAAV serotype may be, or have, a sequence as described in U.S. Pat. No. 9,238,800, the contents of which are herein incorporated by reference in their entirety, such as, but not limited to, AAAV (SEQ ID NO: 1, 2, 4, 6, 8, 10, 12, and 14 of U.S. Pat. No. 9,238,800), or variants thereof.

In one embodiment, the AAV may be a bovine AAV (BAAV). The BAAV serotype may be, or have, a sequence as described in U.S. Pat. No. 9,193,769, the contents of which are herein incorporated by reference in their entirety, such as, but not limited to, BAAV (SEQ ID NO: 1 and 6 of U.S. Pat. No. 9,193,769), or variants thereof. The BAAV serotype may be or have a sequence as described in U.S. Pat. No. 7,427,396, the contents of which are herein incorporated by reference in their entirety, such as, but not limited to, BAAV (SEQ ID NO: 5 and 6 of US7,427,396), or variants thereof.

In one embodiment, the AAV may be a caprine AAV. The caprine AAV serotype may be, or have a sequence as described in U.S. Pat. No. 7,427,396, the contents of which are herein incorporated by reference in their entirety, such as, but not limited to, caprine AAV (SEQ ID NO: 3 of U.S. Pat. No. 7,427,396), or variants thereof.

In other embodiments, the AAV may be engineered as a hybrid AAV from two or more parental serotypes. In one embodiment, the AAV may be AAV2G9 which comprises sequences from AAV2 and AAV9. The AAV2G9 AAV serotype may be, or have, a sequence as described in United States Patent Publication No. US20160017005, the contents of which are herein incorporated by reference in its entirety.

In one embodiment, the AAV may be a serotype generated by the AAV9 capsid library with mutations in amino acids 390-627 (VP1 numbering) as described by Pulitherla et al. (Molecular Therapy 19(6):1070-1078 (2011), the contents of which are herein incorporated by reference in their entirety. The serotype and corresponding nucleotide and amino acid substitutions may be, but is not limited to, AAV9.1 (G1594C; D532H), AAV6.2 (T1418A and T1436X; V473D and I479K), AAV9.3 (T1238A; F413Y), AAV9.4 (T1250C and A1617T; F417S), AAV9.5 (A1235G, A1314T, A1642G, C1760T; Q412R, T548A, A587V), AAV9.6 (T1231A; F11I), AAV9.9 (G1203A, G1785T; W595C), AAV9.10 (A1500G, T1676C; M559T), AAV9.11 (A1425T, A1702C, A1769T; T568P, Q590L), AAV9.13 (A1369C, A1720T; N457H, T574S), AAV9.14 (T1340A, T1362C, T1560C, G1713A; L447H), AAV9.16 (A1775T; Q592L), AAV9.24 (T1507C, T1521G, W503R), AAV9.26 (A1337G, A1769C; Y446C, Q590P), AAV9.33 (A4667C; D556A), AAV9.34 (A1534G, C1794T; N512D), AAV9.35 (A1289T, T1450A, C1494T, A1515T, C1794A, G1816A; Q430L, Y484N, N98K, V606I), AAV9.40 (A1694T, E565V), AAV9.41 (A1348T, T1362C, T450S), AAV9.44 (A1684C, A1701T, A1737G; N562H, K567N), AAV9.45 (A1492T, C1804T; N498Y, L602F), AAV9.46 (G1441C, T1525C, T1549G; G481R, W509R, L517V), 9.47 (G1241A, G1358A, A1669G, C1745T; S414N, G453D, K557E, T582I), AAV9.48 (C1445T, A1736T; P482L, Q579L), AAV9.50 (A1638T, C1683T, T1805A, G546H, L602H), AAV9.53 (G1301A, A1405C, C1664T, G1811T; R134Q, S469R, A555V, G604V), AAV9.54 (C1531A, T1609A; L511I, L537M), AAV9.55 (T1605A, F535L), AAV9.58 (C1475T, C1579A, T492I, H527N), (T1336C; Y446H), AAV9.61 (A1493T; N498I), AAV9.64 (C1531A, A1617T; L511I), AAV9.65 (C1335T, T1530C, C1568A; A523D), AAV9.68 (C1510A; P504T), AAV9.80 (G1441A, G481R), AAV9.83 (C1402A, A1500T; P468T, E500D), AAV9.87 (T1464C, T1468C, S490P), AAV9.90 (A1196T; Y399F), AA9.91 (T1316G, A1583T, C1782G, T1806C; L439R, K528I), AAV9.93 (A1273G, A1421G, A1638C, C1712T, G1732A, A1744T, A1832T; S425G, Q474R, Q546H, P571L, G578R, T582S, D611V), AAV9.94 (A1675T, M559L) and AAV9.95 (T1605A; F535L).

In some embodiments, the AAV serotype may be, or have, a sequence as described in International Publication No. WO2016049230, the contents of which are herein incorporated by reference in their entirely, such as, but not limited to AAVF1/HSC1 (SEQ ID NO: 2 and 20 of WO2016049230), AAVF2/HSC2 (SEQ ID NO: 3 and 21 of WO2016049230), AAVF3/HSC3 (SEQ ID NO: 5 and 22 of WO2016049230), AAVF4/HSC4 (SEQ ID NO: 6 and 23 of WO2016049230), AAVF5/HSC5 (SEQ ID NO: 11 and 25 of WO2016049230), AAVF6/HSC6 (SEQ ID NO: 7 and 24 of WO2016049230), AAVF7/HSC7 (SEQ ID NO: 8 and 27 of WO2016049230), AAVF8/HSC8 (SEQ ID NO: 9 and 28 of WO2016049230), AAVF9/HSC9 (SEQ ID NO: 10 and 29 of WO2016049230), AAVF11/HSC11 (SEQ ID NO: 4 and 26 of WO2016049230), AAVF12/HSC12 (SEQ ID NO: 12 and 30 of WO2016049230), AAVF13/HSC13 (SEQ ID NO: 14 and 31 of WO2016049230), AAVF14/HSC14 (SEQ ID NO: 15 and 32 of WO2016049230), AAVF15/HSC15 (SEQ ID NO: 16 and 33 of WO2016049230), AAVF16/HSC16 (SEQ ID NO: 17 and 34 of WO2016049230), AAVF17/HSC17 (SEQ ID NO: 13 and 35 of WO2016049230), or variants or derivatives thereof.

In some embodiments, the AAV serotype may be, or have, a sequence as described in U.S. Pat. No. 8,734,809, the contents of which are herein incorporated by reference in their entirety, such as, hut not limited to, AAV CBr-E1 (SEQ ID NO: 13 and 87 of U.S. Pat. No. 8,734,809) AAV CBr-E2 (SEQ ID NO: 14 and 88 of U.S. Pat. No. 8,734,809), AAV CBr-E3 (SEQ ID NO: 15 and 89 of U.S. Pat. No. 8,734,809), AAV CBr-E4 (SEQ ID NO: 16 and 90 of U.S. Pat. No. 8,734,809), AAV CBr-E5 (SEQ ID NO: 17 and 91 of U.S. Pat. No. 8,734,809), AAV CBr-e5 (SEQ ID NO: 18 and 92 of U.S. Pat. No. 8,734,809), AAV CBr-E6 (SEQ ID NO: 19 and 93 of U.S. Pat. No. 8,734,809), AAV CBr-E7 (SEQ ID NO: 20 and 94 of U.S. Pat. No. 8,734,809), AAV CBr-E8 (SEQ ID NO: 21 and 95 of U.S. Pat. No. 8,734,809), AAV CLv-D1 (SEQ ID NO: 22 and 96 of U.S. Pat. No. 8,734,809), AAV CLv-D2 (SEQ ID NO: 23 and 97 of U.S. Pat. No. 8,734,809), AAV CLv-D3 (SEQ ID NO: 24 and 98 of U.S. Pat. No. 8,734,809), AAV CLv-D4 (SEQ ID NO: 25 and 99 of U.S. Pat. No. 8,734,809), AAV CLv-D5 (SEQ ID NO: 26 and 100 of U.S. Pat. No. 8,734,809), AAV CLv-D6 (SEQ ID NO: 27 and 101 of U.S. Pat. No. 8,734,809), AAV CLv-D7 (SEQ ID NO: 28 and 102 of U.S. Pat. No. 8,734,809), AAV CLv-D8 (SEQ ID NO: 29 and 103 of U.S. Pat. No. 8,734,809), AAV (SEQ ID NO: 13 and 87 of U.S. Pat. No. 8,734,809), AAV CLv-R1 (SEQ ID NO: 30 and 104 of U.S. Pat. No. 8,734,809), AAV CLv-R2 (SEQ ID NO: 31 and 105 of U.S. Pat. No. 8,734,809), AAV CLv-R3 (SEQ ID NO: 32 and 106 of U.S. Pat. No. 8,734,809), AAV CLv-R4 (SEQ ID NO: 33 and 107 of U.S. Pat. No. 8,734,809), AAV CLv-R5 (SEQ ID NO: 34 and 108 of U.S. Pat. No. 8,734,809), AAV CLv-R6 (SEQ ID NO: 35 and 109 of U.S. Pat. No. 8,734,809), AAV CLv-R7 (SEQ ID NO: 36 and 110 of U.S. Pat. No. 8,734,809), AAV CLv-R8 (SEQ ID NO: 37 and 111 of U.S. Pat. No. 8,734,809), AAV CLv-R9 (SEQ ID NO: 38 and 112 of U.S. Pat. No. 8,734,809), AAV CLg-F1 (SEQ ID NO: 39 and 113 of U.S. Pat. No. 8,734,809), AAV CLg-F2 (SEQ ID NO: 40 and 114 of U.S. Pat. No. 8,734,809), AAV CLg-F3 (SEQ ID NO: 41 and 115 of U.S. Pat. No. 8,734,809), AAV CLg-F4 (SEQ ID NO: 42 and 116 of U.S. Pat. No. 8,734,809), AAV CLg-F5 (SEQ ID NO: 43 and 117 of U.S. Pat. No. 8,734,809), AAV CLg-F6 (SEQ ID NO: 43 and 117 of U.S. Pat. No. 8,734,809), AAV CLg-F7 (SEQ ID NO: 44 and 11$ of U.S. Pat. No. 8,734,809), AAV CLg-F8 (SEQ ID NO: 43 and 117 of U.S. Pat. No. 8,734,809), AAV CSp-1 (SEQ ID NO: 45 and 119 of U.S. Pat. No. 8,734,809), AAV CSp-10 (SEQ ID NO: 46 and 120 of U.S. Pat. No. 8,734,809), AAV CSp-11 (SEQ ID NO: 47 and 121 of U.S. Pat. No. 8,734,809), AAV CSp-2 (SEQ ID NO: 48 and 122 of U.S. Pat. No. 8,734,809), AAV CSp-3 (SEQ ID NO: 49 and 123 of U.S. Pat. No. 8,734,809), CSp-4 (SEQ ID NO: 50 and 124 of U.S. Pat. No. 8,734,809), AAV CSp-6 (SEQ ID NO: 51 and 125 of U.S. Pat. No. 8,734,809), AAV CSp-7 (SEQ ID NO: 52 and 126 of U.S. Pat. No. 8,734,809), AAV CSp-8 (SEQ ID NO: 53 and 127 of U.S. Pat. No. 8,734,809), AAV CSp-9 (SEQ ID NO: 54 and 128 of U.S. Pat. No. 8,734,809), AAV CHt-2 (SEQ ID NO: 55 and 129 of U.S. Pat. No. 8,734,809), AAV (SEQ ID NO: 56 and 130 of U.S. Pat. No. 8,734,809), AAV CKd-1 (SEQ ID NO: 57 and 131 of U.S. Pat. No. 8,734,809), AAV CKd-10 (SEQ ID NO: 58 and 132 of U.S. Pat. No. 8,734,809), AAV CKd-2 (SEQ ID NO: 59 and 133 of U.S. Pat. No. 8,734,809), AAV CKd-3 (SEQ ID NO: 60 and 134 of U.S. Pat. No. 8,734,809), AAV CKd-4 (SEQ ID NO: 61 and 135 of U.S. Pat. No. 8,734,809), AAV CKd-6 (SEQ ID NO: 62 and 136 of U.S. Pat. No. 8,734,809), AAV CKd-7 (SEQ ID NO: 63 and 137 of U.S. Pat. No. 8,734,809) AAV CKd-8 (SEQ ID NO: 64 and 138 of U.S. Pat. No. 8,734,809), AAV CLv-1 (SEQ ID NO: 35 and 139 of U.S. Pat. No. 8,734,809), AAV CLv-12 (SEQ ID NO: 66 and 140 of U.S. Pat. No. 8,734,809), AAV CLv-13 (SEQ ID NO: 67 and 141 of U.S. Pat. No. 8,734,809), AAV CLv-2 (SEQ ID NO: 68 and 142 of U.S. Pat. No. 8,734,809), AAV CLv-3 (SEQ ID NO: 69 and 143 of U.S. Pat. No. 8,734,809), AAV CLv-4 (SEQ ID NO: 70 and 144 of U.S. Pat. No. 8,734,809), AAV CLv-6 (SEQ ID NO: 71 and 145 of U.S. Pat. No. 8,734,809), AAV CLv-8 (SEQ ID NO: 72 and 146 of U.S. Pat. No. 8,734,809), AAV CKd-B1 (SEQ ID NO: 73 and 147 of U.S. Pat. No. 8,734,809), AAV CKd-B2 (SEQ ID NO: 74 and 148 of U.S. Pat. No. 8,734,809), AAV CKd-B3 (SEQ ID NO: 75 and 149 of U.S. Pat. No. 8,734,809), AAV CKd-B4 (SEQ ID NO: 76 and 150 of U.S. Pat. No. 8,734,809), AAV CKd-B5 (SEQ ID NO: 77 and 151 of U.S. Pat. No. 8,734,809), AAV CKd-B6 (SEQ ID NO: 78 and 152 of U.S. Pat. No. 8,734,809), AAV CKd-B7 (SEQ ID NO: 79 and 153 of U.S. Pat. No. 8,734,809), AAV CKd-B8 (SEQ ID NO: 80 and 154 of U.S. Pat. No. 8,734,809), AAV CKd-H1 (SEQ ID NO: 81 and 155 of U.S. Pat. No. 8,734,809), AAV CKd-H2 (SEQ ID NO: 82 and 156 of U.S. Pat. No. 8,734,809), AAV CKd-H3 (SEQ ID NO: 83 and 157 of U.S. Pat. No. 8,734,809), AAV CKd-H4 (SEQ ID NO: 84 and 158 of U.S. Pat. No. 8,734,809), AAV CKd-H5 (SEQ ID NO: 85 and 159 of U.S. Pat. No. 8,734,809), AAV CKd-H6 (SEQ ID NO: 77 and 151 of U.S. Pat. No. 8,734,809), AAV CHt-1 (SEQ ID NO: 86 and 160 of U.S. Pat. No. 8,734,809), AAV CLv1-1 (SEQ ID NO: 171 of U.S. Pat. No. 8,734,809), AAV CLv1-2 (SEQ ID NO: 172 of U.S. Pat. No. 8,734,809), AAV CLv1-3 (SEQ ID NO: 173 of U.S. Pat. No. 8,734,809), AAV CLv1-4 (SEQ ID NO: 174 of U.S. Pat. No. 8,734,809), AAV Clv1-7 (SEQ ID NO: 175 of U.S. Pat. No. 8,734,809), AAV Clv1-8 (SEQ ID NO: 176 of U.S. Pat. No. 8,734,809), AAV Clv1-9 (SEQ ID NO: 177 of U.S. Pat. No. 8,734,809), AAV Clv1-10 (SEQ ID NO: 178 of U.S. Pat. No. 8,734,809), AAV.VR-355 (SEQ fir) NO: 181 of U.S. Pat. No. 8,734,809), AAV.hu.48R3 (SEQ ID NO: 183 of U.S. Pat. No. 8,734,809), or variants or derivatives thereof.

In some embodiments, the AAV serotype may be, or have, a sequence as described in International Publication No. WO2016065001, the contents of which are herein incorporated by reference in their entirety, such as, but not limited to AAV CHt-P2 (SEQ ID NO: 1 and 51 of WO2016065001), AAV CHt-P5 (SEQ ID NO: 2 and 52 of WO2016065001), AAV CHt-P9 (SEQ ID NO: 3 and 53 of WO2016065001), AAV CBr-7.1 (SEQ ID NO: 4 and 54 of WO2016065001), AAV CBr-7.2 (SEQ ID NO: 5 and 55 of WO2016065001), AAV CBr-7.3 (SEQ ID NO: 6 and 56 of WO2016065001), AAV CBr-7.4 (SEQ ID NO: 7 and 57 of WO2016065001), AAV CBr-7.5 (SEQ ID NO: 8 and 58 of WO2016065001), AAV CBr-7.7 (SEQ ID NO: 9 and 59 of WO2016065001), AAV CBr-7.8 (SEQ ID NO: 10 and 60 of WO2016065001), AAV CBr-7.10 (SEQ ID NO: 11 and 61 of WO2016065001), AAV CKd-N3 (SEQ ID NO: 12 and 62 of WO2016065001), AAV CKd-N4 (SEQ ID NO: 13 and 63 of WO2016065001), AAV CKd-N9 (SEQ ID NO: 14 and 64 of WO2016065001), AAV CLv-L4 (SEQ ID NO: 15 and 65 of WO2016065001), AAV CLv-L5 (SEQ ID NO: 16 and 66 of WO2016065001), AAV CLv-L6 (SEQ ID NO: 17 and 67 of WO2016065001), AAV CLv-K1 (SEQ ID NO: 18 and 68 of WO2016065001), AAV CLv-K3 (SEQ ID NO: 19 and 69 of WO2016065001), AAV CLv-K6 (SEQ ID NO: 20 and 70 of WO2016065001), AAV CLv-M1 (SEQ ID NO: 21 and 71 of WO2016065001), AAV CLv-M11 (SEQ ID NO: 22 and 72 of WO2016065001), AAV CLv-M2 (SEQ ID NO: 23 and 73 of WO2016065001), AAV CLv-M5 (SEQ ID NO: 24 and 74 of WO2016065001), AAV CLv-M6 (SEQ ID NO: 25 and 75 of WO2016065001), AAV CLv-M7 (SEQ ID NO: 26 and 76 of WO2016065001), AAV CLv-M8 (SEQ ID NO: 27 and 77 of WO2016065001), AAV CLv-M9 (SEQ ID NO: 28 and 78 of WO2016065001), AAV CHt-P1 (SEQ ID NO: 29 and 79 of WO2016065001), AAV CHt-P6 (SEQ ID NO: 30 and 80 of WO2016065001), AAV CHt-P8 (SEQ ID NO: 31 and 81 of WO2016065001), AAV CHt-6.1 (SEQ ID NO: 32 and 82 of WO2016065001), AAV CHt-6.10 (SEQ ID NO: 33 and 83 of WO2016065001), AAV CHt-6.5 (SEQ ID NO: 34 and 84 of WO2016065001), AAV CHt-6.6 (SEQ ID NO: 35 and 85 of WO2016065001), AAV CHt-6.7 (SEQ ID NO: 36 and 86 of WO2016065001), AAV CHt-6.8 (SEQ ID NO: 37 and 87 of WO2016061001), AAV CSp-8.10 (SEQ ID NO: 38 and 88 of WO2016065001), AAV CSp-8.2 (SEQ ID NO: 39 and 89 of WO2016065001), AAV CSp-8.4 (SEQ ID NO: 40 and 90 of WO2016065001), AAV CSp-8.5 (SEQ ID NO: 41 and 91 of WO2016065001), AAV CSp-8.6 (SEQ ID NO: 42 and 92 of WO2016065001), AAV CSp-8.7 (SEQ ID NO: 43 and 93 of WO2016065001), AAV CSp-8.8 (SEQ ID NO: 44 and 94 of WO2016065001), AAV CSp-8.9 (SEQ ID NO: 45 and 95 of WO2016065001), AAV CBr-B7.3 (SEQ ID NO: 46 and 96 of WO2016065001), AAV CBr-B7.4 (SEQ ID NO: 47 and 97 of WO2016065001), AAV3B (SEQ ID NO: 48 and 98 of WO2016065001), AAV4 (SEQ ID NO: 49 and 99 of WO2016065001), AAV5 (SEQ ID NO: 50 and 100 of WO2016065001), or variants or derivatives thereof.

In one embodiment, the AAV may be a, serotype selected from any of those found in Table 1.

In one embodiment, the AAV may comprise a sequence, fragment or variant thereof, of the sequences in Table 1.

In one embodiment, the AAV may be encoded by a sequence, fragment or variant as described in Table 1.

TABLE 1

AAV Serotypes

| Serotype | SEQ ID NO | Reference Information |
| --- | --- | --- |
| AAV1 | 1 | US20150159173 SEQ ID NO: 11, US20150315612 SEQ ID NO: 202 |
| AAV1 | 2 | US20160017295 SEQ ID NO: 1US20030138772 SEQ ID NO: 64, US20150159173 SEQ ID NO: 27, US20150315612 SEQ ID NO: 219, U.S. Pat. No. 7,198,951 SEQ ID NO: 5 |
| AAV1 | 3 | US20030138772 SEQ ID NO: 6 |
| AAV1.3 | 4 | US20030138772 SEQ ID NO: 14 |
| AAV10 | 5 | US20030138772 SEQ ID NO: 117 |
| AAV10 | 6 | WO2015121501 SEQ ID NO: 9 |
| AAV10 | 7 | WO2015121501 SEQ ID NO: 8 |
| AAV11 | 8 | US20030138772 SEQ ID NO: 118 |
| AAV12 | 9 | US20030138772 SEQ ID NO: 119 |
| AAV2 | 10 | US20150159173 SEQ ID NO: 7, US20150315612 SEQ ID NO: 211 |
| AAV2 | 11 | US20030138772 SEQ ID NO: 70, US20150159173 SEQ ID NO: 23, US20150315612 SEQ ID NO: 221, US20160017295 SEQ ID NO: 2, U.S. Pat. No. 6,156,303 SEQ ID NO: 4, U.S. Pat. No. 7,198,951 SEQ ID NO: 4, WO2015121501 SEQ ID NO: 1 |
| AAV2 | 12 | U.S. Pat. No. 6,156,303 SEQ ID NO: 8 |
| AAV2 | 13 | US20030138772 SEQ ID NO: 7 |
| AAV2 | 14 | U.S. Pat. No. 6,156,303 SEQ ID NO: 3 |
| AAV2.5T | 15 | U.S. Pat. No. 9,233,131 SEQ ID NO: 42 |
| AAV223.10 | 16 | US20030138772 SEQ ID NO: 75 |
| AAV223.2 | 17 | US20030138772 SEQ ID NO: 49 |
| AAV223.2 | 18 | US20030138772 SEQ ID NO: 76 |
| AAV223.4 | 19 | US20030138772 SEQ ID NO: 50 |
| AAV223.4 | 20 | US20030138772 SEQ ID NO: 73 |
| AAV223.5 | 21 | US20030138772 SEQ ID NO: 51 |
| AAV223.5 | 22 | US20030138772 SEQ ID NO: 74 |
| AAV223.6 | 23 | US20030138772 SEQ ID NO: 52 |
| AAV223.6 | 24 | US20030138772 SEQ ID NO: 78 |
| AAV223.7 | 25 | US20030138772 SEQ ID NO: 53 |
| AAV223.7 | 26 | US20030138772 SEQ ID NO: 77 |
| AAV29.3 | 27 | US20030138772 SEQ ID NO: 82 |
| AAV29.4 | 28 | US20030138772 SEQ ID NO: 12 |
| AAV29.5 | 29 | US20030138772 SEQ ID NO: 83 |
| AAV29.5 (AAVbb.2) | 30 | US20030138772 SEQ ID NO: 13 |
| AAV3 | 31 | US20150159173 SEQ ID NO: 12 |
| AAV3 | 32 | US20030138772 SEQ ID NO: 71, US20150159173 SEQ ID NO: 28, US20160017295 SEQ ID NO: 3, U.S. Pat. No. 7,198,951 SEQ ID NO: 6 |
| AAV3 | 33 | US20030138772 SEQ ID NO: 8 |
| AAV3.3b | 34 | US20030138772 SEQ ID NO: 72 |
| AAV3-3 | 35 | US20150315612 SEQ ID NO: 200 |
| AAV3-3 | 36 | US20150315612 SEQ ID NO: 217 |
| AAV3a | 37 | U.S. Pat. No. 6,156,303 SEQ ID NO: 5 |
| AAV3a | 38 | U.S. Pat. No. 6,156,303 SEQ ID NO: 9 |
| AAV3b | 39 | U.S. Pat. No. 6,156,303 SEQ ID NO: 6 |
| AAV3b | 40 | U.S. Pat. No. 6,156,303 SEQ ID NO: 10 |
| AAV3b | 41 | U.S. Pat. No. 6,156,303 SEQ ID NO: 1 |
| AAV4 | 42 | US20140348794 SEQ ID NO: 17 |
| AAV4 | 43 | US20140348794 SEQ ID NO: 5 |
| AAV4 | 44 | US20140348794 SEQ ID NO: 3 |
| AAV4 | 45 | US20140348794 SEQ ID NO: 14 |
| AAV4 | 46 | US20140348794 SEQ ID NO: 15 |
| AAV4 | 47 | US20140348794 SEQ ID NO: 19 |
| AAV4 | 48 | US20140348794 SEQ ID NO: 12 |
| AAV4 | 49 | US20140348794 SEQ ID NO: 13 |
| AAV4 | 50 | US20140348794 SEQ ID NO: 7 |
| AAV4 | 51 | US20140348794 SEQ ID NO: 8 |
| AAV4 | 52 | US20140348794 SEQ ID NO: 9 |
| AAV4 | 53 | US20140348794 SEQ ID NO: 2 |
| AAV4 | 54 | US20140348794 SEQ ID NO: 10 |
| AAV4 | 55 | US20140348794 SEQ ID NO: 11 |
| AAV4 | 56 | US20140348794 SEQ ID NO: 18 |
| AAV4 | 57 | US20030138772 SEQ ID NO: 63, US20160017295 SEQ ID NO: 4, US20140348794 SEQ ID NO: 4 |
| AAV4 | 58 | US20140348794 SEQ ID NO: 16 |
| AAV4 | 59 | US20140348794 SEQ ID NO: 20 |
| AAV4 | 60 | US20140348794 SEQ ID NO: 6 |
| AAV4 | 61 | US20140348794 SEQ ID NO: 1 |
| AAV42.2 | 62 | US20030138772 SEQ ID NO: 9 |
| AAV42.2 | 63 | US20030138772 SEQ ID NO: 102 |
| AAV42.3b | 64 | US20030138772 SEQ ID NO: 36 |
| AAV42.3B | 65 | US20030138772 SEQ ID NO: 107 |
| AAV42.4 | 66 | US20030138772 SEQ ID NO: 33 |
| AAV42.4 | 67 | US20030138772 SEQ ID NO: 88 |
| AAV42.8 | 68 | US20030138772 SEQ ID NO: 27 |
| AAV42.8 | 69 | US20030138772 SEQ ID NO: 85 |
| AAV43.1 | 70 | US20030138772 SEQ ID NO: 39 |
| AAV43.1 | 71 | US20030138772 SEQ ID NO: 92 |
| AAV43.12 | 72 | US20030138772 SEQ ID NO: 41 |
| AAV43.12 | 73 | US20030138772 SEQ ID NO: 93 |
| AAV43.20 | 74 | US20030138772 SEQ ID NO: 42 |
| AAV43.20 | 75 | US20030138772 SEQ ID NO: 99 |
| AAV43.21 | 76 | US20030138772 SEQ ID NO: 43 |
| AAV43.21 | 77 | US20030138772 SEQ ID NO: 96 |
| AAV43.23 | 78 | US20030138772 SEQ ID NO: 44 |
| AAV43.23 | 79 | US20030138772 SEQ ID NO: 98 |
| AAV43.25 | 80 | US20030138772 SEQ ID NO: 45 |
| AAV43.25 | 81 | US20030138772 SEQ ID NO: 97 |
| AAV43.5 | 82 | US20030138772 SEQ ID NO: 40 |
| AAV43.5 | 83 | US20030138772 SEQ ID NO: 94 |
| AAV4-4 | 84 | US20150315612 SEQ ID NO: 201 |
| AAV4-4 | 85 | US20150315612 SEQ ID NO: 218 |
| AAV44.1 | 86 | US20030138772 SEQ ID NO: 46 |
| AAV44.1 | 87 | US20030138772 SEQ ID NO: 79 |
| AAV44.5 | 88 | US20030138772 SEQ ID NO: 47 |
| AAV44.5 | 89 | US20030138772 SEQ ID NO: 80 |
| AAV4407 | 90 | US20150315612 SEQ ID NO: 90 |
| AAV5 | 91 | U.S. Pat. No. 7,427,396 SEQ ID NO: 1 |
| AAV5 | 92 | US20030138772 SEQ ID NO: 114 |
| AAV5 | 93 | US20160017295 SEQ ID NO: 5, U.S. Pat. No. 7,427,396 SEQ ID NO: 2, US20150315612 SEQ ID NO: 216 |
| AAV5 | 94 | US20150315612 SEQ ID NO: 199 |
| AAV6 | 95 | US20150159173 SEQ ID NO: 13 |
| AAV6 | 96 | US20030138772 SEQ ID NO: 65, US20150159173 SEQ ID NO: 29, US20160017295 SEQ ID NO: 6, U.S. Pat. No. 6,156,303 SEQ ID NO: 7 |
| AAV6 | 97 | U.S. Pat. No. 6,156,303 SEQ ID NO: 11 |
| AAV6 | 98 | U.S. Pat. No. 6,156,303 SEQ ID NO: 2 |
| AAV6 | 99 | US20150315612 SEQ ID NO: 203 |

TABLE 1-continued

AAV Serotypes

| Serotype | SEQ ID NO | Reference Information |
|---|---|---|
| AAV6 | 100 | US20150315612 SEQ ID NO: 220 |
| AAV6.1 | 101 | US20150159173 |
| AAV6.12 | 102 | US20150159173 |
| AAV6.2 | 103 | US20150159173 |
| AAV7 | 104 | US20150159173 SEQ ID NO: 14 |
| AAV7 | 105 | US20150315612 SEQ ID NO: 183 |
| AAV7 | 106 | US20030138772 SEQ ID NO: 2, US20150159173 SEQ ID NO: 30, US20150315612 SEQ ID NO: 181, US20160017295 SEQ ID NO: 7 |
| AAV7 | 107 | US20030138772 SEQ ID NO: 3 |
| AAV7 | 108 | US20030138772 SEQ ID NO: 1, US20150315612 SEQ ID NO: 180 |
| AAV7 | 109 | US20150315612 SEQ ID NO: 213 |
| AAV7 | 110 | US20150315612 SEQ ID NO: 222 |
| AAV8 | 111 | US20150159173 SEQ ID NO: 15 |
| AAV8 | 112 | US20150376240 SEQ ID NO: 7 |
| AAV8 | 113 | US20030138772 SEQ ID NO: 4, US20150315612 SEQ ID NO: 182 |
| AAV8 | 114 | US20030138772 SEQ ID NO: 95, US20140359799 SEQ ID NO: 1, US20150159173 SEQ ID NO: 31, US20160017295 SEQ ID NO: 8, U.S. Pat. No. 7,198,951 SEQ ID NO: 7, US20150315612 SEQ ID NO: 223 |
| AAV8 | 115 | US20150376240 SEQ ID NO: 8 |
| AAV8 | 116 | US20150315612 SEQ ID NO: 214 |
| AAV-8b | 117 | US20150376240 SEQ ID NO: 5 |
| AAV-8b | 118 | US20150376240 SEQ ID NO: 3 |
| AAV-8h | 119 | US20150376240 SEQ ID NO: 6 |
| AAV-8h | 120 | US20150376240 SEQ ID NO: 4 |
| AAV9 | 121 | US20030138772 SEQ ID NO: 5 |
| AAV9 | 122 | U.S. Pat. No. 7,198,951 SEQ ID NO: 1 |
| AAV9 | 123 | US20160017295 SEQ ID NO: 9 |
| AAV9 | 124 | US20030138772 SEQ ID NO: 100, U.S. Pat. No. 7,198,951 SEQ ID NO: 2 |
| AAV9 | 125 | U.S. Pat. No. 7,198,951 SEQ ID NO: 3 |
| AAV9 (AAVhu.14) | 126 | U.S. Pat. No. 7,906,111 SEQ ID NO: 3; WO2015038958 SEQ ID NO: 11 |
| AAV9 (AAVhu.14) | 127 | U.S. Pat. No. 7,906,111 SEQ ID NO: 123; WO2015038958 SEQ ID NO: 2 |
| AAVA3.1 | 128 | US20030138772 SEQ ID NO: 120 |
| AAVA3.3 | 129 | US20030138772 SEQ ID NO: 57 |
| AAVA3.3 | 130 | US20030138772 SEQ ID NO: 66 |
| AAVA3.4 | 131 | US20030138772 SEQ ID NO: 54 |
| AAVA3.4 | 132 | US20030138772 SEQ ID NO: 68 |
| AAVA3.5 | 133 | US20030138772 SEQ ID NO: 55 |
| AAVA3.5 | 134 | US20030138772 SEQ ID NO: 69 |
| AAVA3.7 | 135 | US20030138772 SEQ ID NO: 56 |
| AAVA3.7 | 136 | US20030138772 SEQ ID NO: 67 |
| AAV29.3 (AAVbb.1) | 137 | US20030138772 SEQ ID NO: 11 |
| AAVC2 | 138 | US20030138772 SEQ ID NO: 61 |
| AAVCh.5 | 139 | US20150159173 SEQ ID NO: 46, US20150315612 SEQ ID NO: 234 |
| AAVcy.2 (AAV13.3) | 140 | US20030138772 SEQ ID NO: 15 |
| AAV24.1 | 141 | US20030138772 SEQ ID NO: 101 |
| AAVcy.3 (AAV24.1) | 142 | US20030138772 SEQ ID NO: 16 |
| AAV27.3 | 143 | US20030138772 SEQ ID NO: 104 |
| AAVcy.4 (AAV27.3) | 144 | US20030138772 SEQ ID NO: 17 |
| AAVcy.5 | 145 | US20150315612 SEQ ID NO: 227 |
| AAV7.2 | 146 | US20030138772 SEQ ID NO: 103 |
| AAVcy.5 (AAV7.2) | 147 | US20030138772 SEQ ID NO: 18 |
| AAV16.3 | 148 | US20030138772 SEQ ID NO: 105 |
| AAVcy.6 (AAV16.3) | 149 | US20030138772 SEQ ID NO: 10 |
| AAVcy.5 | 150 | US20150159173 SEQ ID NO: 8 |
| AAVcy.5 | 151 | US20150159173 SEQ ID NO: 24 |
| AAVCy.5R1 | 152 | US20150159173 |
| AAVCy.5R2 | 153 | US20150159173 |
| AAVCy.5R3 | 154 | US20150159173 |
| AAVCy.5R4 | 155 | US20150159173 |
| AAVDJ | 156 | US20140359799 SEQ ID NO: 3, U.S. Pat. No. 7,588,772 SEQ ID NO: 2 |
| AAVDJ | 157 | US20140359799 SEQ ID NO: 2, U.S. Pat. No. 7,588,772 SEQ ID NO: 1 |
| AAVDJ-8 | 158 | U.S. Pat. No. 7,588,772; Grimm et al 2008 |
| AAVDJ-8 | 159 | U.S. Pat. No. 7,588,772; Grimm et al 2008 |
| AAVF5 | 160 | US20030138772 SEQ ID NO: 110 |
| AAVH2 | 161 | US20030138772 SEQ ID NO: 26 |
| AAVH6 | 162 | US20030138772 SEQ ID NO: 25 |
| AAVhE1.1 | 163 | U.S. Pat. No. 9,233,131 SEQ ID NO: 44 |
| AAVhEr1.14 | 164 | U.S. Pat. No. 9,233,131 SEQ ID NO: 46 |
| AAVhEr1.16 | 165 | U.S. Pat. No. 9,233,131 SEQ ID NO: 48 |
| AAVhEr1.18 | 166 | U.S. Pat. No. 9,233,131 SEQ ID NO: 49 |
| AAVhEr1.23 (AAVhEr2.29) | 167 | U.S. Pat. No. 9,233,131 SEQ ID NO: 53 |
| AAVhEr1.35 | 168 | U.S. Pat. No. 9,233,131 SEQ ID NO: 50 |
| AAVhEr1.36 | 169 | U.S. Pat. No. 9,233,131 SEQ ID NO: 52 |
| AAVhEr1.5 | 170 | U.S. Pat. No. 9,233,131 SEQ ID NO: 45 |
| AAVhEr1.7 | 171 | U.S. Pat. No. 9,233,131 SEQ ID NO: 51 |
| AAVhEr1.8 | 172 | U.S. Pat. No. 9,233,131 SEQ ID NO: 47 |
| AAVhEr2.16 | 173 | U.S. Pat. No. 9,233,131 SEQ ID NO: 55 |
| AAVhEr2.30 | 174 | U.S. Pat. No. 9,233,131 SEQ ID NO: 56 |
| AAVhEr2.31 | 175 | U.S. Pat. No. 9,233,131 SEQ ID NO: 58 |
| AAVhEr2.36 | 176 | U.S. Pat. No. 9,233,131 SEQ ID NO: 57 |
| AAVhEr2.4 | 177 | U.S. Pat. No. 9,233,131 SEQ ID NO: 54 |
| AAVhEr3.1 | 178 | U.S. Pat. No. 9,233,131 SEQ ID NO: 59 |
| AAVhu.1 | 179 | US20150315612 SEQ ID NO: 46 |
| AAVhu.1 | 180 | US20150315612 SEQ ID NO: 144 |
| AAVhu.10 (AAV16.8) | 181 | US20150315612 SEQ ID NO: 56 |
| AAVhu.10 (AAV16.8) | 182 | US20150315612 SEQ ID NO: 156 |
| AAVhu.11 (AAV16.12) | 183 | US20150315612 SEQ ID NO: 57 |
| AAVhu.11 (AAV16.12) | 184 | US20150315612 SEQ ID NO: 153 |
| AAVhu.12 | 185 | US20150315612 SEQ ID NO: 59 |
| AAVhu.12 | 186 | US20150315612 SEQ ID NO: 154 |
| AAVhu.13 | 187 | US20150159173 SEQ ID NO: 16, US20150315612 SEQ ID NO: 71 |
| AAVhu.13 | 188 | US20150159173 SEQ ID NO: 32, US20150315612 SEQ ID NO: 129 |
| AAVhu.136.1 | 189 | US20150315612 SEQ ID NO: 165 |
| AAVhu.140.1 | 190 | US20150315612 SEQ ID NO: 166 |
| AAVhu.140.2 | 191 | US20150315612 SEQ ID NO: 167 |
| AAVhu.145.6 | 192 | US20150315612 SEQ ID No: 178 |
| AAVhu.15 | 193 | US20150315612 SEQ ID NO: 147 |
| AAVhu.15 (AAV33.4) | 194 | US20150315612 SEQ ID NO: 50 |
| AAVhu.156.1 | 195 | US20150315612 SEQ ID No: 179 |
| AAVhu.16 | 196 | US20150315612 SEQ ID NO: 148 |
| AAVhu.16 (AAV33.8) | 197 | US20150315612 SEQ ID NO: 51 |
| AAVhu.17 | 198 | US20150315612 SEQ ID NO: 83 |
| AAVhu.17 (AAV33.12) | 199 | US20150315612 SEQ ID NO: 4 |
| AAVhu.172.1 | 200 | US20150315612 SEQ ID NO: 171 |
| AAVhu.172.2 | 201 | US20150315612 SEQ ID NO: 172 |
| AAVhu.173.4 | 202 | US20150315612 SEQ ID NO: 173 |
| AAVhu.173.8 | 203 | US20150315612 SEQ ID NO: 175 |
| AAVhu.18 | 204 | US20150315612 SEQ ID NO: 52 |
| AAVhu.18 | 205 | US20150315612 SEQ ID NO: 149 |
| AAVhu.19 | 206 | US20150315612 SEQ ID NO: 62 |
| AAVhu.19 | 207 | US20150315612 SEQ ID NO: 133 |
| AAVhu.2 | 208 | US20150315612 SEQ ID NO: 48 |
| AAVhu.2 | 209 | US20150315612 SEQ ID NO: 143 |
| AAVhu.20 | 210 | US20150315612 SEQ ID NO: 63 |
| AAVhu.20 | 211 | US20150315612 SEQ ID NO: 134 |
| AAVhu.21 | 212 | US20150315612 SEQ ID NO: 65 |
| AAVhu.21 | 213 | US20150315612 SEQ ID NO: 135 |
| AAVhu.22 | 214 | US20150315612 SEQ ID NO: 67 |
| AAVhu.22 | 215 | US20150315612 SEQ ID NO: 138 |
| AAVhu.23 | 216 | US20150315612 SEQ ID NO: 60 |
| AAVhu.23.2 | 217 | US20150315612 SEQ ID NO: 137 |

TABLE 1-continued

AAV Serotypes

| Serotype | SEQ ID NO | Reference Information |
|---|---|---|
| AAVhu.24 | 218 | US20150315612 SEQ ID NO: 66 |
| AAVhu.24 | 219 | US20150315612 SEQ ID NO: 136 |
| AAVhu.25 | 220 | US20150315612 SEQ ID NO: 49 |
| AAVhu.25 | 221 | US20150315612 SEQ ID NO: 146 |
| AAVhu.26 | 222 | US20150159173 SEQ ID NO: 17, US20150315612 SEQ ID NO: 61 |
| AAVhu.26 | 223 | US20150159173 SEQ ID NO: 33, US20150315612 SEQ ID NO: 139 |
| AAVhu.27 | 224 | US20150315612 SEQ ID NO: 64 |
| AAVhu.27 | 225 | US20150315612 SEQ ID NO: 140 |
| AAVhu.28 | 226 | US20150315612 SEQ ID NO: 68 |
| AAVhu.28 | 227 | US20150315612 SEQ ID NO: 130 |
| AAVhu.29 | 228 | US20150315612 SEQ ID NO: 69 |
| AAVhu.29 | 229 | US20150159173 SEQ ID NO: 42, US20150315612 SEQ ID NO: 132 |
| AAVhu.29 | 230 | US20150315612 SEQ ID NO: 225 |
| AAVhu.29R | 231 | US20150159173 |
| AAVhu.3 | 232 | US20150315612 SEQ ID NO: 44 |
| AAVhu.3 | 233 | US20150315612 SEQ ID NO: 145 |
| AAVhu.30 | 234 | US20150315612 SEQ ID NO: 70 |
| AAVhu.30 | 235 | US20150315612 SEQ ID NO: 131 |
| AAVhu.31 | 236 | US20150315612 SEQ ID NO: 1 |
| AAVhu.31 | 237 | US20150315612 SEQ ID NO: 121 |
| AAVhu.32 | 238 | US20150315612 SEQ ID NO: 2 |
| AAVhu.32 | 239 | US20150315612 SEQ ID NO: 122 |
| AAVhu.33 | 240 | US20150315612 SEQ ID NO: 75 |
| AAVhu.33 | 241 | US20150315612 SEQ ID NO: 124 |
| AAVhu.34 | 242 | US20150315612 SEQ ID NO: 72 |
| AAVhu.34 | 243 | US20150315612 SEQ ID NO: 125 |
| AAVhu.35 | 244 | US20150315612 SEQ ID NO: 73 |
| AAVhu.35 | 245 | US20150315612 SEQ ID NO: 164 |
| AAVhu.36 | 246 | US20150315612 SEQ ID NO: 74 |
| AAVhu.36 | 247 | US20150315612 SEQ ID NO: 126 |
| AAVhu.37 | 248 | US20150159173 SEQ ID NO: 34, US20150315612 SEQ ID NO: 88 |
| AAVhu.37 (AAV106.1) | 249 | US20150315612 SEQ ID NO: 10, US20150159173 SEQ ID NO: 18 |
| AAVhu.38 | 250 | US20150315612 SEQ ID NO: 161 |
| AAVhu.39 | 251 | US20150315612 SEQ ID NO: 102 |
| AAVhu.39 (AAVLG-9) | 252 | US20150315612 SEQ ID NO: 24 |
| AAVhu.4 | 253 | US20150315612 SEQ ID NO: 47 |
| AAVhu.4 | 254 | US20150315612 SEQ ID NO: 141 |
| AAVhu.40 | 255 | US20150315612 SEQ ID NO: 87 |
| AAVhu.40 (AAV114.3) | 256 | US20150315612 SEQ ID No: 11 |
| AAVhu.41 | 257 | US20150315612 SEQ ID NO: 91 |
| AAVhu.41 (AAV127.2) | 258 | US20150315612 SEQ ID NO: 6 |
| AAVhu.42 | 259 | US20150315612 SEQ ID NO: 85 |
| AAVhu.42 (AAV127.5) | 260 | US20150315612 SEQ ID NO: 8 |
| AAVhu.43 | 261 | US20150315612 SEQ ID NO: 160 |
| AAVhu.43 | 262 | US20150315612 SEQ ID NO: 236 |
| AAVhu.43 (AAV128.1) | 263 | US20150315612 SEQ ID NO: 80 |
| AAVhu.44 | 264 | US20150159173 SEQ ID NO: 45, US20150315612 SEQ ID NO: 158 |
| AAVhu.44 (AAV128.3) | 265 | US20150315612 SEQ ID NO: 81 |
| AAVhu.44R1 | 266 | US20150159173 |
| AAVhu.44R2 | 267 | US20150159173 |
| AAVhu.44R3 | 268 | US20150159173 |
| AAVhu.45 | 269 | US20150315612 SEQ ID NO: 76 |
| AAVhu.45 | 270 | US20150315612 SEQ ID NO: 127 |
| AAVhu.46 | 271 | US20150315612 SEQ ID NO: 82 |
| AAVhu.46 | 272 | US20150315612 SEQ ID NO: 159 |
| AAVhu.46 | 273 | US20150315612 SEQ ID NO: 224 |
| AAVhu.47 | 274 | US20150315612 SEQ ID NO: 77 |
| AAVhu.47 | 275 | US20150315612 SEQ ID NO: 128 |
| AAVhu.48 | 276 | US20150159173 SEQ ID NO: 38 |
| AAVhu.48 | 277 | US20150315612 SEQ ID NO: 157 |
| AAVhu.48 (AAV130.4) | 278 | US20150315612 SEQ ID NO: 78 |
| AAVhu.48R1 | 279 | US20150159173 |
| AAVhu.48R2 | 280 | US20150159173 |
| AAVhu.48R3 | 281 | US20150159173 |
| AAVhu.49 | 282 | US20150315612 SEQ ID NO: 209 |
| AAVhu.49 | 283 | US20150315612 SEQ ID NO: 189 |
| AAVhu.5 | 284 | US20150315612 SEQ ID NO: 45 |
| AAVhu.5 | 285 | US20150315612 SEQ ID NO: 142 |
| AAVhu.51 | 286 | US20150315612 SEQ ID NO: 208 |
| AAVhu.51 | 287 | US20150315612 SEQ ID NO: 190 |
| AAVhu.52 | 288 | US20150315612 SEQ ID NO: 210 |
| AAVhu.52 | 289 | US20150315612 SEQ ID NO: 191 |
| AAVhu.53 | 290 | US20150159173 SEQ ID NO: 19 |
| AAVhu.53 | 291 | US20150159173 SEQ ID NO: 35 |
| AAVhu.53 (AAV145.1) | 292 | US20150315612 SEQ ID NO: 176 |
| AAVhu.54 | 293 | US20150315612 SEQ ID NO: 188 |
| AAVhu.54 (AAV145.5) | 294 | US20150315612 SEQ ID No: 177 |
| AAVhu.55 | 295 | US20150315612 SEQ ID NO: 187 |
| AAVhu.56 | 296 | US20150315612 SEQ ID NO: 205 |
| AAVhu.56 (AAV145.6) | 297 | US20150315612 SEQ ID NO: 168 |
| AAVhu.56 (AAV145.6) | 298 | US20150315612 SEQ ID NO: 192 |
| AAVhu.57 | 299 | US20150315612 SEQ ID NO: 206 |
| AAVhu.57 | 300 | US20150315612 SEQ ID NO: 169 |
| AAVhu.57 | 301 | US20150315612 SEQ ID NO: 193 |
| AAVhu.58 | 302 | US20150315612 SEQ ID NO: 207 |
| AAVhu.58 | 303 | US20150315612 SEQ ID NO: 194 |
| AAVhu.6 (AAV3.1) | 304 | US20150315612 SEQ ID NO: 5 |
| AAVhu.6 (AAV3.1) | 305 | US20150315612 SEQ ID NO: 84 |
| AAVhu.60 | 306 | US20150315612 SEQ ID NO: 184 |
| AAVhu.60 (AAV161.10) | 307 | US20150315612 SEQ ID NO: 170 |
| AAVhu.61 | 308 | US20150315612 SEQ ID NO: 185 |
| AAVhu.61 (AAV161.6) | 309 | US20150315612 SEQ ID NO: 174 |
| AAVhu.63 | 310 | US20150315612 SEQ ID NO: 204 |
| AAVhu.63 | 311 | US20150315612 SEQ ID NO: 195 |
| AAVhu.64 | 312 | US20150315612 SEQ ID NO: 212 |
| AAVhu.64 | 313 | US20150315612 SEQ ID NO: 196 |
| AAVhu.66 | 314 | US20150315612 SEQ ID NO: 197 |
| AAVhu.67 | 315 | US20150315612 SEQ ID NO: 215 |
| AAVhu.67 | 316 | US20150315612 SEQ ID NO: 198 |
| AAVhu.7 | 317 | US20150315612 SEQ ID NO: 226 |
| AAVhu.7 | 318 | US20150315612 SEQ ID NO: 150 |
| AAVhu.7 (AAV7.3) | 319 | US20150315612 SEQ ID NO: 55 |
| AAVhu.71 | 320 | US20150315612 SEQ ID NO: 79 |
| AAVhu.8 | 321 | US20150315612 SEQ ID NO: 53 |
| AAVhu.8 | 322 | US20150315612 SEQ ID NO: 12 |
| AAVhu.8 | 323 | US20150315612 SEQ ID NO: 151 |
| AAVhu.9 (AAV3.1) | 324 | US20150315612 SEQ ID NO: 58 |
| AAVhu.9 (AAV3.1) | 325 | US20150315612 SEQ ID NO: 155 |
| AAV-LK01 | 326 | US20150376607 SEQ ID NO: 2 |
| AAV-LK01 | 327 | US20150376607 SEQ ID NO: 29 |
| AAV-LK02 | 328 | US20150376607 SEQ ID NO: 3 |
| AAV-LK02 | 329 | US20150376607 SEQ ID NO: 30 |
| AAV-LK03 | 330 | US20150376607 SEQ ID NO: 4 |
| AAV-LK03 | 331 | WO2015121501 SEQ ID NO: 12, US20150376607 SEQ ID NO: 31 |
| AAV-LK04 | 332 | US20150376607 SEQ ID NO: 5 |
| AAV-LK04 | 333 | US20150376607 SEQ ID NO: 32 |
| AAV-LK05 | 334 | US20150376607 SEQ ID NO: 6 |
| AAV-LK05 | 335 | US20150376607 SEQ ID NO: 33 |
| AAV-LK06 | 336 | US20150376607 SEQ ID NO: 7 |
| AAV-LK06 | 337 | US20150376607 SEQ ID NO: 34 |
| AAV-LK07 | 338 | US20150376607 SEQ ID NO: 8 |
| AAV-LK07 | 339 | US20150376607 SEQ ID NO: 35 |
| AAV-LK08 | 340 | US20150376607 SEQ ID NO: 9 |
| AAV-LK08 | 341 | US20150376607 SEQ ID NO: 36 |

TABLE 1-continued

AAV Serotypes

| Serotype | SEQ ID NO | Reference Information |
|---|---|---|
| AAV-LK09 | 342 | US20150376607 SEQ ID NO: 10 |
| AAV-LK09 | 343 | US20150376607 SEQ ID NO: 37 |
| AAV-LK10 | 344 | US20150376607 SEQ ID NO: 11 |
| AAV-LK10 | 345 | US20150376607 SEQ ID NO: 38 |
| AAV-LK11 | 346 | US20150376607 SEQ ID NO: 12 |
| AAV-LK11 | 347 | US20150376607 SEQ ID NO: 39 |
| AAV-LK12 | 348 | US20150376607 SEQ ID NO: 13 |
| AAV-LK12 | 349 | US20150376607 SEQ ID NO: 40 |
| AAV-LK13 | 350 | US20150376607 SEQ ID NO: 14 |
| AAV-LK13 | 351 | US20150376607 SEQ ID NO: 41 |
| AAV-LK14 | 352 | US20150376607 SEQ ID NO: 15 |
| AAV-LK14 | 353 | US20150376607 SEQ ID NO: 42 |
| AAV-LK15 | 354 | US20150376607 SEQ ID NO: 16 |
| AAV-LK15 | 355 | US20150376607 SEQ ID NO: 43 |
| AAV-LK16 | 356 | US20150376607 SEQ ID NO: 17 |
| AAV-LK16 | 357 | US20150376607 SEQ ID NO: 44 |
| AAV-LK17 | 358 | US20150376607 SEQ ID NO: 18 |
| AAV-LK17 | 359 | US20150376607 SEQ ID NO: 45 |
| AAV-LK18 | 360 | US20150376607 SEQ ID NO: 19 |
| AAV-LK18 | 361 | US20150376607 SEQ ID NO: 46 |
| AAV-LK19 | 362 | US20150376607 SEQ ID NO: 20 |
| AAV-LK19 | 363 | US20150376607 SEQ ID NO: 47 |
| AAV-PAEC | 364 | US20150376607 SEQ ID NO: 1 |
| AAV-PAEC | 365 | US20150376607 SEQ ID NO: 48 |
| AAV-PAEC11 | 366 | US20150376607 SEQ ID NO: 26 |
| AAV-PAEC11 | 367 | US20150376607 SEQ ID NO: 54 |
| AAV-PAEC12 | 368 | US20150376607 SEQ ID NO: 27 |
| AAV-PAEC12 | 369 | US20150376607 SEQ ID NO: 51 |
| AAV-PAEC13 | 370 | US20150376607 SEQ ID NO: 28 |
| AAV-PAEC13 | 371 | US20150376607 SEQ ID NO: 49 |
| AAV-PAEC2 | 372 | US20150376607 SEQ ID NO: 21 |
| AAV-PAEC2 | 373 | US20150376607 SEQ ID NO: 56 |
| AAV-PAEC4 | 374 | US20150376607 SEQ ID NO: 22 |
| AAV-PAEC4 | 375 | US20150376607 SEQ ID NO: 55 |
| AAV-PAEC6 | 376 | US20150376607 SEQ ID NO: 23 |
| AAV-PAEC6 | 377 | US20150376607 SEQ ID NO: 52 |
| AAV-PAEC7 | 378 | US20150376607 SEQ ID NO: 24 |
| AAV-PAEC7 | 379 | US20150376607 SEQ ID NO: 53 |
| AAV-PAEC8 | 380 | US20150376607 SEQ ID NO: 25 |
| AAV-PAEC8 | 381 | US20150376607 SEQ ID NO: 50 |
| AAVpi.1 | 382 | US20150315612 SEQ ID NO: 28 |
| AAVpi.1 | 383 | US20150315612 SEQ ID NO: 93 |
| AAVpi.2 | 384 | US20150315612 SEQ ID NO: 30 |
| AAVpi.2 | 385 | US20150315612 SEQ ID NO: 95 |
| AAVpi.3 | 386 | US20150315612 SEQ ID NO: 29 |
| AAVpi.3 | 387 | US20150315612 SEQ ID NO: 94 |
| AAVrh.10 | 388 | US20150159173 SEQ ID NO: 9 |
| AAVrh.10 | 389 | US20150159173 SEQ ID NO: 25 |
| AAV44.2 | 390 | US20030138772 SEQ ID NO: 59 |
| AAVrh.10 (AAV44.2) | 391 | US20030138772 SEQ ID NO: 81 |
| AAV42.1B | 392 | US20030138772 SEQ ID NO: 90 |
| AAVrh.12 (AAV42.1b) | 393 | US20030138772 SEQ ID NO: 30 |
| AAVrh.13 | 394 | US20150159173 SEQ ID NO: 10 |
| AAVrh.13 | 395 | US20150159173 SEQ ID NO: 26 |
| AAVrh.13 | 396 | US20150315612 SEQ ID NO: 228 |
| AAVrh.13R | 397 | US20150159173 |
| AAV42.3A | 398 | US20030138772 SEQ ID NO: 87 |
| AAVrh.14 (AAV42.3a) | 399 | US20030138772 SEQ ID NO: 32 |
| AAV42.5A | 400 | US20030138772 SEQ ID NO: 89 |
| AAVrh.17 (AAV42.5a) | 401 | US20030138772 SEQ ID NO: 34 |
| AAV42.5B | 402 | US20030138772 SEQ ID NO: 91 |
| AAVrh.18 (AAV42.5b) | 403 | US20030138772 SEQ ID NO: 29 |
| AAV42.6B | 404 | US20030138772 SEQ ID NO: 112 |
| AAVrh.19 (AAV42.6b) | 405 | US20030138772 SEQ ID NO: 38 |
| AAVrh.2 | 406 | US20150159173 SEQ ID NO: 39 |
| AAVrh.2 | 407 | US20150315612 SEQ ID NO: 231 |
| AAVrh.20 | 408 | US20150159173 SEQ ID NO: 1 |
| AAV42.10 | 409 | US20030138772 SEQ ID NO: 106 |
| AAVrh.21 (AAV42.10) | 410 | US20030138772 SEQ ID NO: 35 |
| AAV42.11 | 411 | US20030138772 SEQ ID NO: 108 |
| AAVrh.22 (AAV42.11) | 412 | US20030138772 SEQ ID NO: 37 |
| AAV42.12 | 413 | US20030138772 SEQ ID NO: 113 |
| AAVrh.23 (AAV42.12) | 414 | US20030138772 SEQ ID NO: 58 |
| AAV42.13 | 415 | US20030138772 SEQ ID NO: 86 |
| AAVrh.24 (AAV42.13) | 416 | US20030138772 SEQ ID NO: 31 |
| AAV42.15 | 417 | US20030138772 SEQ ID NO: 84 |
| AAVrh.25 (AAV42.15) | 418 | US20030138772 SEQ ID NO: 28 |
| AAVrh.2R | 419 | US20150159173 |
| AAVrh.31 (AAV223.1) | 420 | US20030138772 SEQ ID NO: 48 |
| AAVC1 | 421 | US20030138772 SEQ ID NO: 60 |
| AAVrh.32 (AAVC1) | 422 | US20030138772 SEQ ID NO: 19 |
| AAVrh.32/33 | 423 | US20150159173 SEQ ID NO: 2 |
| AAVrh.33 (AAVC3) | 424 | US20030138772 SEQ ID NO: 20 |
| AAVC5 | 425 | US20030138772 SEQ ID NO: 62 |
| AAVrh.34 (AAVC5) | 426 | US20030138772 SEQ ID NO: 21 |
| AAVF1 | 427 | US20030138772 SEQ ID NO: 109 |
| AAVrh.35 (AAVF1) | 428 | US20030138772 SEQ ID NO: 22 |
| AAVF3 | 429 | US20030138772 SEQ ID NO: 111 |
| AAVrh.36 (AAVF3) | 430 | US20030138772 SEQ ID NO: 23 |
| AAVrh.37 | 431 | US20030138772 SEQ ID NO: 24 |
| AAVrh.37 | 432 | US20150159173 SEQ ID NO: 40 |
| AAVrh.37 | 433 | US20150315612 SEQ ID NO: 229 |
| AAVrh.37R2 | 434 | US20150159173 |
| AAVrh.38 (AAVLG-4) | 435 | US20150315612 SEQ ID NO: 7 |
| AAVrh.38 (AAVLG-4) | 436 | US20150315612 SEQ ID NO: 86 |
| AAVrh.39 | 437 | US20150159173 SEQ ID NO: 20, US20150315612 SEQ ID NO: 13 |
| AAVrh.39 | 438 | US20150159173 SEQ ID NO: 3, US20150159173 SEQ ID NO: 36, US20150315612 SEQ ID NO: 89 |
| AAVrh.40 | 439 | US20150315612 SEQ ID NO: 92 |
| AAVrh.40 (AAVLG-10) | 440 | US20150315612 SEQ ID No: 14 |
| AAVrh.43 (AAVN721-R) | 441 | US20150315612 SEQ ID NO: 43, US20150159173 SEQ ID NO: 21 |
| AAVrh.43 (AAVN721-8) | 442 | US20150315612 SEQ ID NO: 163, US20150159173 SEQ ID NO: 37 |
| AAVrh.44 | 443 | US20150315612 SEQ ID NO: 34 |
| AAVrh.44 | 444 | US20150315612 SEQ ID NO: 111 |
| AAVrh.45 | 445 | US20150315612 SEQ ID NO: 41 |
| AAVrh.45 | 446 | US20150315612 SEQ ID NO: 109 |
| AAVrh.46 | 447 | US20150159173 SEQ ID NO: 22, US20150315612 SEQ ID NO: 19 |
| AAVrh.46 | 448 | US20150159173 SEQ ID NO: 4, US20150315612 SEQ ID NO: 101 |
| AAVrh.47 | 449 | US20150315612 SEQ ID NO: 38 |
| AAVrh.47 | 450 | US20150315612 SEQ ID NO: 118 |
| AAVrh.48 | 451 | US20150159173 SEQ ID NO: 44, US20150315612 SEQ ID NO: 115 |
| AAVrh.48.1 | 452 | US20150159173 |
| AAVrh.48.1.2 | 453 | US20150159173 |
| AAVrh.48.2 | 454 | US20150159173 |
| AAVrh.48 (AAV1-7) | 455 | US20150315612 SEQ ID NO: 32 |
| AAVrh.49 (AAV1-8) | 456 | US20150315612 SEQ ID NO: 25 |
| AAVrh.49 (AAV1-8) | 457 | US20150315612 SEQ ID NO: 103 |
| AAVrh.50 (AAV2-4) | 458 | US20150315612 SEQ ID NO: 23 |

TABLE 1-continued

AAV Serotypes

| Serotype | SEQ ID NO | Reference Information |
|---|---|---|
| AAVrh.50 (AAV2-4) | 459 | US20150315612 SEQ ID NO: 108 |
| AAVrh.51 (AAV2-5) | 460 | US20150315612 SEQ ID No: 22 |
| AAVrh.51 (AAV2-5) | 461 | US20150315612 SEQ ID NO: 104 |
| AAVrh.52 (AAV3-9) | 462 | US20150315612 SEQ ID NO: 18 |
| AAVrh.52 (AAV3-9) | 463 | US20150315612 SEQ ID NO: 96 |
| AAVrh.53 | 464 | US20150315612 SEQ ID NO: 97 |
| AAVrh.53 (AAV3-11) | 465 | US20150315612 SEQ ID NO: 17 |
| AAVrh.53 (AAV3-11) | 466 | US20150315612 SEQ ID NO: 186 |
| AAVrh.54 | 467 | US20150315612 SEQ ID NO: 40 |
| AAVrh.54 | 468 | US20150159173 SEQ ID NO: 49, US20150315612 SEQ ID NO: 116 |
| AAVrh.55 | 469 | US20150315612 SEQ ID NO: 37 |
| AAVrh.55 (AAV4-19) | 470 | US20150315612 SEQ ID NO: 117 |
| AAVrh.56 | 471 | US20150315612 SEQ ID NO: 54 |
| AAVrh.56 | 472 | US20150315612 SEQ ID NO: 152 |
| AAVrh.57 | 473 | US20150315612 SEQ ID NO: 26 |
| AAVrh.57 | 474 | US20150315612 SEQ ID NO: 105 |
| AAVrh.58 | 475 | US20150315612 SEQ ID NO: 27 |
| AAVrh.58 | 476 | US20150159173 SEQ ID NO: 48, US20150315612 SEQ ID NO: 106 |
| AAVrh.58 | 477 | US20150315612 SEQ ID NO: 232 |
| AAVrh.59 | 478 | US20150315612 SEQ ID NO: 42 |
| AAVrh.59 | 479 | US20150315612 SEQ ID NO: 110 |
| AAVrh.60 | 480 | US20150315612 SEQ ID NO: 31 |
| AAVrh.60 | 481 | US20150315612 SEQ ID NO: 120 |
| AAVrh.61 | 482 | US20150315612 SEQ ID NO: 107 |
| AAVrh.61 (AAV2-3) | 483 | US20150315612 SEQ ID NO: 21 |
| AAVrh.62 (AAV2-15) | 484 | US20150315612 SEQ ID No: 33 |
| AAVrh.62 (AAV2-15) | 485 | US20150315612 SEQ ID NO: 114 |
| AAVrh.64 | 486 | US20150315612 SEQ ID No: 15 |
| AAVrh.64 | 487 | US20150159173 SEQ ID NO: 43, US20150315612 SEQ ID NO: 99 |
| AAVrh.64 | 488 | US20150315612 SEQ ID NO: 233 |
| AAVRh.64R1 | 489 | US20150159173 |
| AAVRh.64R2 | 490 | US20150159173 |
| AAVrh.65 | 491 | US20150315612 SEQ ID NO: 35 |
| AAVrh.65 | 492 | US20150315612 SEQ ID NO: 112 |
| AAVrh.67 | 493 | US20150315612 SEQ ID NO: 36 |
| AAVrh.67 | 494 | US20150315612 SEQ ID NO: 230 |
| AAVrh.67 | 495 | US20150159173 SEQ ID NO: 47, US20150315612 SEQ ID NO: 113 |
| AAVrh.68 | 496 | US20150315612 SEQ ID NO: 16 |
| AAVrh.68 | 497 | US20150315612 SEQ ID NO: 100 |
| AAVrh.69 | 498 | US20150315612 SEQ ID NO: 39 |
| AAVrh.69 | 499 | US20150315612 SEQ ID NO: 119 |
| AAVrh.70 | 500 | US20150315612 SEQ ID NO: 20 |
| AAVrh.70 | 501 | US20150315612 SEQ ID NO: 98 |
| AAVrh.71 | 502 | US20150315612 SEQ ID NO: 162 |
| AAVrh.72 | 503 | US20150315612 SEQ ID NO: 9 |
| AAVrh.73 | 504 | US20150159173 SEQ ID NO: 5 |
| AAVrh.74 | 505 | US20150159173 SEQ ID NO: 6 |
| AAVrh.8 | 506 | US20150159173 SEQ ID NO: 41 |
| AAVrh.8 | 507 | US20150315612 SEQ ID NO: 235 |
| AAVrh.8R | 508 | US20150159173, WO2015168666 SEQ ID NO: 9 |
| AAVrh.8R A586R mutant | 509 | WO2015168666 SEQ ID NO: 10 |
| AAVrh.8R R533A mutant | 510 | WO2015168666 SEQ ID NO: 11 |
| BAAV (bovine AAV) | 511 | U.S. Pat. No. 9,193,769 SEQ ID NO: 8 |
| BAAV (bovine AAV) | 512 | U.S. Pat. No. 9,193,769 SEQ ID NO: 10 |
| BAAV (bovine AAV) | 513 | U.S. Pat. No. 9,193,769 SEQ ID NO: 4 |
| BAAV (bovine AAV) | 514 | U.S. Pat. No. 9,193,769 SEQ ID NO: 2 |
| BAAV (bovine AAV) | 515 | U.S. Pat. No. 9,193,769 SEQ ID NO: 6 |
| BAAV (bovine AAV) | 516 | U.S. Pat. No. 9,193,769 SEQ ID NO: 1 |
| BAAV (bovine AAV) | 517 | U.S. Pat. No. 9,193,769 SEQ ID NO: 5 |
| BAAV (bovine AAV) | 518 | U.S. Pat. No. 9,193,769 SEQ ID NO: 3 |
| BAAV (bovine AAV) | 519 | U.S. Pat. No. 9,193,769 SEQ ID NO: 11 |
| BAAV (bovine AAV) | 520 | U.S. Pat. No. 7,427,396 SEQ ID NO: 5 |
| BAAV (bovine AAV) | 521 | U.S. Pat. No. 7,427,396 SEQ ID NO: 6 |
| BAAV (bovine AAV) | 522 | U.S. Pat. No. 9,193,769 SEQ ID NO: 7 |
| BAAV (bovine AAV) | 523 | U.S. Pat. No. 9,193,769 SEQ ID NO: 9 |
| BNP61 AAV | 524 | US20150238550 SEQ ID NO: 1 |
| BNP61 AAV | 525 | US20150238550 SEQ ID NO: 2 |
| BNP62 AAV | 526 | US20150238550 SEQ ID NO: 3 |
| BNP63 AAV | 527 | US20150238550 SEQ ID NO: 4 |
| caprine AAV | 528 | U.S. Pat. No. 7,427,396 SEQ ID NO: 3 |
| caprine AAV | 529 | U.S. Pat. No. 7,427,396 SEQ ID NO: 4 |
| true type AAV (ttAAV) | 530 | WO2015121501 SEQ ID NO: 2 |
| AAAV (Avian AAV) | 531 | U.S. Pat. No. 9,238,800 SEQ ID NO: 12 |
| AAAV (Avian AAV) | 532 | U.S. Pat. No. 9,238,800 SEQ ID NO: 2 |
| AAAV (Avian AAV) | 533 | U.S. Pat. No. 9,238,800 SEQ ID NO: 6 |
| AAAV (Avian AAV) | 534 | U.S. Pat. No. 9,238,800 SEQ ID NO: 4 |
| AAAV (Avian AAV) | 535 | U.S. Pat. No. 9,238,800 SEQ ID NO: 8 |
| AAAV (Avian AAV) | 536 | U.S. Pat. No. 9,238,800 SEQ ID NO: 14 |
| AAAV (Avian AAV) | 537 | U.S. Pat. No. 9,238,800 SEQ ID NO: 10 |
| AAAV (Avian AAV) | 538 | U.S. Pat. No. 9,238,800 SEQ ID NO: 15 |
| AAAV (Avian AAV) | 539 | U.S. Pat. No. 9,238,800 SEQ ID NO: 5 |
| AAAV (Avian AAV) | 540 | U.S. Pat. No. 9,238,800 SEQ ID NO: 9 |
| AAAV (Avian AAV) | 541 | U.S. Pat. No. 9,238,800 SEQ ID NO: 3 |
| AAAV (Avian AAV) | 542 | U.S. Pat. No. 9,238,800 SEQ ID NO: 7 |
| AAAV (Avian AAV) | 543 | U.S. Pat. No. 9,238,800 SEQ ID NO: 11 |
| AAAV (Avian AAV) | 544 | U.S. Pat. No. 9,238,800 SEQ ID NO: 13 |
| AAAV (Avian AAV) | 545 | U.S. Pat. No. 9,238,800 SEQ ID NO: 1 |
| AAV Shuffle 100-1 | 546 | US20160017295 SEQ ID NO: 23 |
| AAV Shuffle 100-1 | 547 | US20160017295 SEQ ID NO: 11 |
| AAV Shuffle 100-2 | 548 | US20160017295 SEQ ID NO: 37 |
| AAV Shuffle 100-2 | 549 | US20160017295 SEQ ID NO: 29 |
| AAV Shuffle 100-3 | 550 | US20160017295 SEQ ID NO: 24 |
| AAV Shuffle 100-3 | 551 | US20160017295 SEQ ID NO: 12 |
| AAV Shuffle 100-7 | 552 | US20160017295 SEQ ID NO: 25 |

TABLE 1-continued

AAV Serotypes

| Serotype | SEQ ID NO | Reference Information |
|---|---|---|
| AAV Shuffle 100-7 | 553 | US20160017295 SEQ ID NO: 13 |
| AAV Shuffle 10-2 | 554 | US20160017295 SEQ ID NO: 34 |
| AAV Shuffle 10-2 | 555 | US20160017295 SEQ ID NO: 26 |
| AAV Shuffle 10-6 | 556 | US20160017295 SEQ ID NO: 35 |
| AAV Shuffle 10-6 | 557 | US20160017295 SEQ ID NO: 27 |
| AAV Shuffle 10-8 | 558 | US20160017295 SEQ ID NO: 36 |
| AAV Shuffle 10-8 | 559 | US20160017295 SEQ ID NO: 28 |
| AAV SM 100-10 | 560 | US20160017295 SEQ ID NO: 41 |
| AAV SM 100-10 | 561 | US20160017295 SEQ ID NO: 33 |
| AAV SM 100-3 | 562 | US20160017295 SEQ ID NO: 40 |
| AAV SM 100-3 | 563 | US20160017295 SEQ ID NO: 32 |
| AAV SM 10-1 | 564 | US20160017295 SEQ ID NO: 38 |
| AAV SM 10-1 | 565 | US20160017295 SEQ ID NO: 30 |
| AAV SM 10-2 | 566 | US20160017295 SEQ ID NO: 10 |
| AAV SM 10-2 | 567 | US20160017295 SEQ ID NO: 22 |
| AAV SM 10-8 | 568 | US20160017295 SEQ ID NO: 39 |
| AAV SM 10-8 | 569 | US20160017295 SEQ ID NO: 31 |
| AAVF1/HSC1 | 570 | WO2016049230 SEQ ID NO: 20 |
| AAVF2/HSC2 | 571 | WO2016049230 SEQ ID NO: 21 |
| AAVF3/HSC3 | 572 | WO2016049230 SEQ ID NO: 22 |
| AAVF4/HSC4 | 573 | WO2016049230 SEQ ID NO: 23 |
| AAVF5/HSC5 | 574 | WO2016049230 SEQ ID NO: 25 |
| AAVF6/HSC6 | 575 | WO2016049230 SEQ ID NO: 24 |
| AAVF7/HSC7 | 576 | WO2016049230 SEQ ID NO: 27 |
| AAVF8/HSC8 | 577 | WO2016049230 SEQ ID NO: 28 |
| AAVF9/HSC9 | 578 | WO2016049230 SEQ ID NO: 29 |
| AAVF11/HSC11 | 579 | WO2016049230 SEQ ID NO: 26 |
| AAVF12/HSC12 | 580 | WO2016049230 SEQ ID NO: 30 |
| AAVF13/HSC13 | 581 | WO2016049230 SEQ ID NO: 31 |
| AAVF14/HSC14 | 582 | WO2016049230 SEQ ID NO: 32 |
| AAVF15/HSC15 | 583 | WO2016049230 SEQ ID NO: 33 |
| AAVF16/HSC16 | 584 | WO2016049230 SEQ ID NO: 34 |
| AAVF17/HSC17 | 585 | WO2016049230 SEQ ID NO: 35 |
| AAVF1/HSC1 | 586 | WO2016049230 SEQ ID NO: 2 |
| AAVF2/HSC2 | 587 | WO2016049230 SEQ ID NO: 3 |
| AAVF3/HSC3 | 588 | WO2016049230 SEQ ID NO: 5 |
| AAVF4/HSC4 | 589 | WO2016049230 SEQ ID NO: 6 |
| AAVF5/HSC5 | 590 | WO2016049230 SEQ ID NO: 11 |
| AAVF6/HSC6 | 591 | WO2016049230 SEQ ID NO: 7 |
| AAVF7/HSC7 | 592 | WO2016049230 SEQ ID NO: 8 |
| AAVF8/HSC8 | 593 | WO2016049230 SEQ ID NO: 9 |
| AAVF9/HSC9 | 594 | WO2016049230 SEQ ID NO: 10 |
| AAVF11/HSC11 | 595 | WO2016049230 SEQ ID NO: 4 |
| AAVF12/HSC12 | 596 | WO2016049230 SEQ ID NO: 12 |
| AAVF13/HSC13 | 597 | WO2016049230 SEQ ID NO: 14 |
| AAVF14/HSC14 | 598 | WO2016049230 SEQ ID NO: 15 |
| AAVF15/HSC15 | 599 | WO2016049230 SEQ ID NO: 16 |
| AAVF16/HSC16 | 600 | WO2016049230 SEQ ID NO: 17 |
| AAVF17/HSC17 | 601 | WO2016049230 SEQ ID NO: 13 |
| AAV CBr-E1 | 602 | U.S. Pat. No. 8,734,809 SEQ ID NO: 13 |
| AAV CBr-E2 | 603 | U.S. Pat. No. 8,734,809 SEQ ID NO: 14 |
| AAV CBr-E3 | 604 | U.S. Pat. No. 8,734,809 SEQ ID NO: 15 |
| AAV CBr-E4 | 605 | U.S. Pat. No. 8,734,809 SEQ ID NO: 16 |
| AAV CBr-E5 | 606 | U.S. Pat. No. 8,734,809 SEQ ID NO: 17 |
| AAV CBr-e5 | 607 | U.S. Pat. No. 8,734,809 SEQ ID NO: 18 |
| AAV CBr-E6 | 608 | U.S. Pat. No. 8,734,809 SEQ ID NO: 19 |
| AAV CBr-E7 | 609 | U.S. Pat. No. 8,734,809 SEQ ID NO: 20 |
| AAV CBr-E8 | 610 | U.S. Pat. No. 8,734,809 SEQ ID NO: 21 |
| AAV CLv-D1 | 611 | U.S. Pat. No. 8,734,809 SEQ ID NO: 22 |
| AAV CLv-D2 | 612 | U.S. Pat. No. 8,734,809 SEQ ID NO: 23 |
| AAV CLv-D3 | 613 | U.S. Pat. No. 8,734,809 SEQ ID NO: 24 |
| AAV CLv-D4 | 614 | U.S. Pat. No. 8,734,809 SEQ ID NO: 25 |
| AAV CLv-D5 | 615 | U.S. Pat. No. 8,734,809 SEQ ID NO: 26 |
| AAV CLv-D6 | 616 | U.S. Pat. No. 8,734,809 SEQ ID NO: 27 |
| AAV CLv-D7 | 617 | U.S. Pat. No. 8,734,809 SEQ ID NO: 28 |
| AAV CLv-D8 | 618 | U.S. Pat. No. 8,734,809 SEQ ID NO: 29 |
| AAV CLv-E1 | 619 | U.S. Pat. No. 8,734,809 SEQ ID NO: 13 |
| AAV CLv-R1 | 620 | U.S. Pat. No. 8,734,809 SEQ ID NO: 30 |
| AAV CLv-R2 | 621 | U.S. Pat. No. 8,734,809 SEQ ID NO: 31 |
| AAV CLv-R3 | 622 | U.S. Pat. No. 8,734,809 SEQ ID NO: 32 |
| AAV CLv-R4 | 623 | U.S. Pat. No. 8,734,809 SEQ ID NO: 33 |
| AAV CLv-R5 | 624 | U.S. Pat. No. 8,734,809 SEQ ID NO: 34 |
| AAV CLv-R6 | 625 | U.S. Pat. No. 8,734,809 SEQ ID NO: 35 |
| AAV CLv-R7 | 626 | U.S. Pat. No. 8,734,809 SEQ ID NO: 36 |
| AAV CLv-R8 | 627 | U.S. Pat. No. 8,734,809 SEQ ID NO: 37 |
| AAV CLv-R9 | 628 | U.S. Pat. No. 8,734,809 SEQ ID NO: 38 |
| AAV CLg-F1 | 629 | U.S. Pat. No. 8,734,809 SEQ ID NO: 39 |
| AAV CLg-F2 | 630 | U.S. Pat. No. 8,734,809 SEQ ID NO: 40 |
| AAV CLg-F3 | 631 | U.S. Pat. No. 8,734,809 SEQ ID NO: 41 |
| AAV CLg-F4 | 632 | U.S. Pat. No. 8,734,809 SEQ ID NO: 42 |
| AAV CLg-F5 | 633 | U.S. Pat. No. 8,734,809 SEQ ID NO: 43 |
| AAV CLg-F6 | 634 | U.S. Pat. No. 8,734,809 SEQ ID NO: 43 |
| AAV CLg-F7 | 635 | U.S. Pat. No. 8,734,809 SEQ ID NO: 44 |
| AAV CLg-F8 | 636 | U.S. Pat. No. 8,734,809 SEQ ID NO: 43 |
| AAV CSp-1 | 637 | U.S. Pat. No. 8,734,809 SEQ ID NO: 45 |
| AAV CSp-10 | 638 | U.S. Pat. No. 8,734,809 SEQ ID NO: 46 |
| AAV CSp-11 | 639 | U.S. Pat. No. 8,734,809 SEQ ID NO: 47 |
| AAV CSp-2 | 640 | U.S. Pat. No. 8,734,809 SEQ ID NO: 48 |
| AAV CSp-3 | 641 | U.S. Pat. No. 8,734,809 SEQ ID NO: 49 |
| AAV CSp-4 | 642 | U.S. Pat. No. 8,734,809 SEQ ID NO: 50 |
| AAV CSp-6 | 643 | U.S. Pat. No. 8,734,809 SEQ ID NO: 51 |
| AAV CSp-7 | 644 | U.S. Pat. No. 8,734,809 SEQ ID NO: 52 |
| AAV CSp-8 | 645 | U.S. Pat. No. 8,734,809 SEQ ID NO: 53 |
| AAV CSp-9 | 646 | U.S. Pat. No. 8,734,809 SEQ ID NO: 54 |
| AAV CHt-2 | 647 | U.S. Pat. No. 8,734,809 SEQ ID NO: 55 |
| AAV CHt-3 | 648 | U.S. Pat. No. 8,734,809 SEQ ID NO: 56 |
| AAV CKd-1 | 649 | U.S. Pat. No. 8,734,809 SEQ ID NO: 57 |
| AAV CKd-10 | 650 | U.S. Pat. No. 8,734,809 SEQ ID NO: 58 |
| AAV CKd-2 | 651 | U.S. Pat. No. 8,734,809 SEQ ID NO: 59 |
| AAV CKd-3 | 652 | U.S. Pat. No. 8,734,809 SEQ ID NO: 60 |
| AAV CKd-4 | 653 | U.S. Pat. No. 8,734,809 SEQ ID NO: 61 |
| AAV CKd-6 | 654 | U.S. Pat. No. 8,734,809 SEQ ID NO: 62 |
| AAV CKd-7 | 655 | U.S. Pat. No. 8,734,809 SEQ ID NO: 63 |
| AAV CKd-8 | 656 | U.S. Pat. No. 8,734,809 SEQ ID NO: 64 |
| AAV CLv-1 | 657 | U.S. Pat. No. 8,734,809 SEQ ID NO: 65 |
| AAV CLv-12 | 658 | U.S. Pat. No. 8,734,809 SEQ ID NO: 66 |
| AAV CLv-13 | 659 | U.S. Pat. No. 8,734,809 SEQ ID NO: 67 |
| AAV CLv-2 | 660 | U.S. Pat. No. 8,734,809 SEQ ID NO: 68 |
| AAV CLv-3 | 661 | U.S. Pat. No. 8,734,809 SEQ ID NO: 69 |
| AAV CLv-4 | 662 | U.S. Pat. No. 8,734,809 SEQ ID NO: 70 |
| AAV CLv-6 | 663 | U.S. Pat. No. 8,734,809 SEQ ID NO: 71 |
| AAV CLv-8 | 664 | U.S. Pat. No. 8,734,809 SEQ ID NO: 72 |
| AAV CKd-B1 | 665 | U.S. Pat. No. 8,734,809 SEQ ID NO: 73 |
| AAV CKd-B2 | 666 | U.S. Pat. No. 8,734,809 SEQ ID NO: 74 |
| AAV CKd-B3 | 667 | U.S. Pat. No. 8,734,809 SEQ ID NO: 75 |
| AAV CKd-B4 | 668 | U.S. Pat. No. 8,734,809 SEQ ID NO: 76 |
| AAV CKd-B5 | 669 | U.S. Pat. No. 8,734,809 SEQ ID NO: 77 |
| AAV CKd-B6 | 670 | U.S. Pat. No. 8,734,809 SEQ ID NO: 78 |
| AAV CKd-B7 | 671 | U.S. Pat. No. 8,734,809 SEQ ID NO: 79 |
| AAV CKd-B8 | 672 | U.S. Pat. No. 8,734,809 SEQ ID NO: 80 |
| AAV CKd-H1 | 673 | U.S. Pat. No. 8,734,809 SEQ ID NO: 81 |
| AAV CKd-H2 | 674 | U.S. Pat. No. 8,734,809 SEQ ID NO: 82 |
| AAV CKd-H3 | 675 | U.S. Pat. No. 8,734,809 SEQ ID NO: 83 |
| AAV CKd-H4 | 676 | U.S. Pat. No. 8,734,809 SEQ ID NO: 84 |
| AAV CKd-H5 | 677 | U.S. Pat. No. 8,734,809 SEQ ID NO: 85 |
| AAV CKd-H6 | 678 | U.S. Pat. No. 8,734,809 SEQ ID NO: 77 |
| AAV CHt-1 | 679 | U.S. Pat. No. 8,734,809 SEQ ID NO: 86 |
| AAV CLv1-1 | 680 | U.S. Pat. No. 8,734,809 SEQ ID NO: 171 |
| AAV CLv1-2 | 681 | U.S. Pat. No. 8,734,809 SEQ ID NO: 172 |
| AAV CLv1-3 | 682 | U.S. Pat. No. 8,734,809 SEQ ID NO: 173 |
| AAV CLv1-4 | 683 | U.S. Pat. No. 8,734,809 SEQ ID NO: 174 |
| AAV Clv1-7 | 684 | U.S. Pat. No. 8,734,809 SEQ ID NO: 175 |
| AAV Clv1-8 | 685 | U.S. Pat. No. 8,734,809 SEQ ID NO: 176 |
| AAV Clv1-9 | 686 | U.S. Pat. No. 8,734,809 SEQ ID NO: 177 |
| AAV Clv1-10 | 687 | U.S. Pat. No. 8,734,809 SEQ ID NO: 178 |
| AAV.VR-355 | 688 | U.S. Pat. No. 8,734,809 SEQ ID NO: 181 |
| AAV.hu.48R3 | 689 | U.S. Pat. No. 8,734,809 SEQ ID NO: 183 |
| AAV CBr-E1 | 690 | U.S. Pat. No. 8,734,809 SEQ ID NO: 87 |
| AAV CBr-E2 | 691 | U.S. Pat. No. 8,734,809 SEQ ID NO: 88 |
| AAV CBr-E3 | 692 | U.S. Pat. No. 8,734,809 SEQ ID NO: 89 |
| AAV CBr-E4 | 693 | U.S. Pat. No. 8,734,809 SEQ ID NO: 90 |
| AAV CBr-E5 | 694 | U.S. Pat. No. 8,734,809 SEQ ID NO: 91 |
| AAV CBr-e5 | 695 | U.S. Pat. No. 8,734,809 SEQ ID NO: 92 |

TABLE 1-continued

AAV Serotypes

| Serotype | SEQ ID NO | Reference Information |
|---|---|---|
| AAV CBr-E6 | 696 | U.S. Pat. No. 8,734,809 SEQ ID NO: 93 |
| AAV CBr-E7 | 697 | U.S. Pat. No. 8,734,809 SEQ ID NO: 94 |
| AAV CBr-E8 | 698 | U.S. Pat. No. 8,734,809 SEQ ID NO: 95 |
| AAV CLv-D1 | 699 | U.S. Pat. No. 8,734,809 SEQ ID NO: 96 |
| AAV CLv-D2 | 700 | U.S. Pat. No. 8,734,809 SEQ ID NO: 97 |
| AAV CLv-D3 | 701 | U.S. Pat. No. 8,734,809 SEQ ID NO: 98 |
| AAV CLv-D4 | 702 | U.S. Pat. No. 8,734,809 SEQ ID NO: 99 |
| AAV CLv-D5 | 703 | U.S. Pat. No. 8,734,809 SEQ ID NO: 100 |
| AAV CLv-D6 | 704 | U.S. Pat. No. 8,734,809 SEQ ID NO: 101 |
| AAV CLv-D7 | 705 | U.S. Pat. No. 8,734,809 SEQ ID NO: 102 |
| AAV CLv-D8 | 706 | U.S. Pat. No. 8,734,809 SEQ ID NO: 103 |
| AAV CLv-E1 | 707 | U.S. Pat. No. 8,734,809 SEQ ID NO: 87 |
| AAV CLv-R1 | 708 | U.S. Pat. No. 8,734,809 SEQ ID NO: 104 |
| AAV CLv-R2 | 709 | U.S. Pat. No. 8,734,809 SEQ ID NO: 105 |
| AAV CLv-R3 | 710 | U.S. Pat. No. 8,734,809 SEQ ID NO: 106 |
| AAV CLv-R4 | 711 | U.S. Pat. No. 8,734,809 SEQ ID NO: 107 |
| AAV CLv-R5 | 712 | U.S. Pat. No. 8,734,809 SEQ ID NO: 108 |
| AAV CLv-R6 | 713 | U.S. Pat. No. 8,734,809 SEQ ID NO: 109 |
| AAV CLv-R7 | 714 | U.S. Pat. No. 8,734,809 SEQ ID NO: 110 |
| AAV CLv-R8 | 715 | U.S. Pat. No. 8,734,809 SEQ ID NO: 111 |
| AAV CLv-R9 | 716 | U.S. Pat. No. 8,734,809 SEQ ID NO: 112 |
| AAV CLg-F1 | 717 | U.S. Pat. No. 8,734,809 SEQ ID NO: 113 |
| AAV CLg-F2 | 718 | U.S. Pat. No. 8,734,809 SEQ ID NO: 114 |
| AAV CLg-F3 | 719 | U.S. Pat. No. 8,734,809 SEQ ID NO: 115 |
| AAV CLg-F4 | 720 | U.S. Pat. No. 8,734,809 SEQ ID NO: 116 |
| AAV CLg-F5 | 721 | U.S. Pat. No. 8,734,809 SEQ ID NO: 117 |
| AAV CLg-F6 | 722 | U.S. Pat. No. 8,734,809 SEQ ID NO: 117 |
| AAV CLg-F7 | 723 | U.S. Pat. No. 8,734,809 SEQ ID NO: 118 |
| AAV CLg-F8 | 724 | U.S. Pat. No. 8,734,809 SEQ ID NO: 117 |
| AAV CSp-1 | 725 | U.S. Pat. No. 8,734,809 SEQ ID NO: 119 |
| AAV CSp-10 | 726 | U.S. Pat. No. 8,734,809 SEQ ID NO: 120 |
| AAV CSp-11 | 727 | U.S. Pat. No. 8,734,809 SEQ ID NO: 121 |
| AAV CSp-2 | 728 | U.S. Pat. No. 8,734,809 SEQ ID NO: 122 |
| AAV CSp-3 | 729 | U.S. Pat. No. 8,734,809 SEQ ID NO: 123 |
| AAV CSp-4 | 730 | U.S. Pat. No. 8,734,809 SEQ ID NO: 124 |
| AAV CSp-6 | 731 | U.S. Pat. No. 8,734,809 SEQ ID NO: 125 |
| AAV CSp-7 | 732 | U.S. Pat. No. 8,734,809 SEQ ID NO: 126 |
| AAV CSp-8 | 733 | U.S. Pat. No. 8,734,809 SEQ ID NO: 127 |
| AAV CSp-9 | 734 | U.S. Pat. No. 8,734,809 SEQ ID NO: 128 |
| AAV CHt-2 | 735 | U.S. Pat. No. 8,734,809 SEQ ID NO: 129 |
| AAV CHt-3 | 736 | U.S. Pat. No. 8,734,809 SEQ ID NO: 130 |
| AAV CKd-1 | 737 | U.S. Pat. No. 8,734,809 SEQ ID NO: 131 |
| AAV CKd-10 | 738 | U.S. Pat. No. 8,734,809 SEQ ID NO: 132 |
| AAV CKd-2 | 739 | U.S. Pat. No. 8,734,809 SEQ ID NO: 133 |
| AAV CKd-3 | 740 | U.S. Pat. No. 8,734,809 SEQ ID NO: 134 |
| AAV CKd-4 | 741 | U.S. Pat. No. 8,734,809 SEQ ID NO: 135 |
| AAV CKd-6 | 742 | U.S. Pat. No. 8,734,809 SEQ ID NO: 136 |
| AAV CKd-7 | 743 | U.S. Pat. No. 8,734,809 SEQ ID NO: 137 |
| AAV CKd-8 | 744 | U.S. Pat. No. 8,734,809 SEQ ID NO: 138 |
| AAV CLv-1 | 745 | U.S. Pat. No. 8,734,809 SEQ ID NO: 139 |
| AAV CLv-12 | 746 | U.S. Pat. No. 8,734,809 SEQ ID NO: 140 |
| AAV CLv-13 | 747 | U.S. Pat. No. 8,734,809 SEQ ID NO: 141 |
| AAV CLv-2 | 748 | U.S. Pat. No. 8,734,809 SEQ ID NO: 142 |
| AAV CLv-3 | 749 | U.S. Pat. No. 8,734,809 SEQ ID NO: 143 |
| AAV CLv-4 | 750 | U.S. Pat. No. 8,734,809 SEQ ID NO: 144 |
| AAV CLv-6 | 751 | U.S. Pat. No. 8,734,809 SEQ ID NO: 145 |
| AAV CLv-8 | 752 | U.S. Pat. No. 8,734,809 SEQ ID NO: 146 |
| AAV CKd-B1 | 753 | U.S. Pat. No. 8,734,809 SEQ ID NO: 147 |
| AAV CKd-B2 | 754 | U.S. Pat. No. 8,734,809 SEQ ID NO: 148 |
| AAV CKd-B3 | 755 | U.S. Pat. No. 8,734,809 SEQ ID NO: 149 |
| AAV CKd-B4 | 756 | U.S. Pat. No. 8,734,809 SEQ ID NO: 150 |
| AAV CKd-B5 | 757 | U.S. Pat. No. 8,734,809 SEQ ID NO: 151 |
| AAV CKd-B6 | 758 | U.S. Pat. No. 8,734,809 SEQ ID NO: 152 |
| AAV CKd-B7 | 759 | U.S. Pat. No. 8,734,809 SEQ ID NO: 153 |
| AAV CKd-B8 | 760 | U.S. Pat. No. 8,734,809 SEQ ID NO: 154 |
| AAV CKd-H1 | 761 | U.S. Pat. No. 8,734,809 SEQ ID NO: 155 |
| AAV CKd-H2 | 762 | U.S. Pat. No. 8,734,809 SEQ ID NO: 156 |
| AAV CKd-H3 | 763 | U.S. Pat. No. 8,734,809 SEQ ID NO: 157 |
| AAV CKd-H4 | 764 | U.S. Pat. No. 8,734,809 SEQ ID NO: 158 |
| AAV CKd-H5 | 765 | U.S. Pat. No. 8,734,809 SEQ ID NO: 159 |
| AAV CKd-H6 | 766 | U.S. Pat. No. 8,734,809 SEQ ID NO: 151 |
| AAV CHt-1 | 767 | U.S. Pat. No. 8,734,809 SEQ ID NO: 160 |
| AAV CHt-P2 | 768 | WO2016065001 SEQ ID NO: 1 |
| AAV CHt-P5 | 769 | WO2016065001 SEQ ID NO: 2 |
| AAV CHt-P9 | 770 | WO2016065001 SEQ ID NO: 3 |
| AAV CBr-7.1 | 771 | WO2016065001 SEQ ID NO: 4 |
| AAV CBr-7.2 | 772 | WO2016065001 SEQ ID NO: 5 |
| AAV CBr-7.3 | 773 | WO2016065001 SEQ ID NO: 6 |
| AAV CBr-7.4 | 774 | WO2016065001 SEQ ID NO: 7 |
| AAV CBr-7.5 | 775 | WO2016065001 SEQ ID NO: 8 |
| AAV CBr-7.7 | 776 | WO2016065001 SEQ ID NO: 9 |
| AAV CBr-7.8 | 777 | WO2016065001 SEQ ID NO: 10 |
| AAV CBr-7.10 | 778 | WO2016065001 SEQ ID NO: 11 |
| AAV CKd-N3 | 779 | WO2016065001 SEQ ID NO: 12 |
| AAV CKd-N4 | 780 | WO2016065001 SEQ ID NO: 13 |
| AAV CKd-N9 | 781 | WO2016065001 SEQ ID NO: 14 |
| AAV CLv-L4 | 782 | WO2016065001 SEQ ID NO: 15 |
| AAV CLv-L5 | 783 | WO2016065001 SEQ ID NO: 16 |
| AAV CLv-L6 | 784 | WO2016065001 SEQ ID NO: 17 |
| AAV CLv-K1 | 785 | WO2016065001 SEQ ID NO: 18 |
| AAV CLv-K3 | 786 | WO2016065001 SEQ ID NO: 19 |
| AAV CLv-K6 | 787 | WO2016065001 SEQ ID NO: 20 |
| AAV CLv-M1 | 788 | WO2016065001 SEQ ID NO: 21 |
| AAV CLv-M11 | 789 | WO2016065001 SEQ ID NO: 22 |
| AAV CLv-M2 | 790 | WO2016065001 SEQ ID NO: 23 |
| AAV CLv-M5 | 791 | WO2016065001 SEQ ID NO: 24 |
| AAV CLv-M6 | 792 | WO2016065001 SEQ ID NO: 25 |
| AAV CLv-M7 | 793 | WO2016065001 SEQ ID NO: 26 |
| AAV CLv-M8 | 794 | WO2016065001 SEQ ID NO: 27 |
| AAV CLv-M9 | 795 | WO2016065001 SEQ ID NO: 28 |
| AAV CHt-P1 | 796 | WO2016065001 SEQ ID NO: 29 |
| AAV CHt-P6 | 797 | WO2016065001 SEQ ID NO: 30 |
| AAV CHt-P8 | 798 | WO2016065001 SEQ ID NO: 31 |
| AAV CHt-6.1 | 799 | WO2016065001 SEQ ID NO: 32 |
| AAV CHt-6.10 | 800 | WO2016065001 SEQ ID NO: 33 |
| AAV CHt-6.5 | 801 | WO2016065001 SEQ ID NO: 34 |
| AAV CHt-6.6 | 802 | WO2016065001 SEQ ID NO: 35 |
| AAV CHt-6.7 | 803 | WO2016065001 SEQ ID NO: 36 |
| AAV CHt-6.8 | 804 | WO2016065001 SEQ ID NO: 37 |
| AAV CSp-8.10 | 805 | WO2016065001 SEQ ID NO: 38 |
| AAV CSp-8.2 | 806 | WO2016065001 SEQ ID NO: 39 |
| AAV CSp-8.4 | 807 | WO2016065001 SEQ ID NO: 40 |
| AAV CSp-8.5 | 808 | WO2016065001 SEQ ID NO: 41 |
| AAV CSp-8.6 | 809 | WO2016065001 SEQ ID NO: 42 |
| AAV CSp-8.7 | 810 | WO2016065001 SEQ ID NO: 43 |
| AAV CSp-8.8 | 811 | WO2016065001 SEQ ID NO: 44 |
| AAV CSp-8.9 | 812 | WO2016065001 SEQ ID NO: 45 |
| AAV CBr-B7.3 | 813 | WO2016065001 SEQ ID NO: 46 |
| AAV CBr-B7.4 | 814 | WO2016065001 SEQ ID NO: 47 |
| AAV3B | 815 | WO2016065001 SEQ ID NO: 48 |
| AAV4 | 816 | WO2016065001 SEQ ID NO: 49 |
| AAV5 | 817 | WO2016065001 SEQ ID NO: 50 |
| AAV CHt-P2 | 818 | WO2016065001 SEQ ID NO: 51 |
| AAV CHt-P5 | 819 | WO2016065001 SEQ ID NO: 52 |
| AAV CHt-P9 | 820 | WO2016065001 SEQ ID NO: 53 |
| AAV CBr-7.1 | 821 | WO2016065001 SEQ ID NO: 54 |
| AAV CBr-7.2 | 822 | WO2016065001 SEQ ID NO: 55 |
| AAV CBr-7.3 | 823 | WO2016065001 SEQ ID NO: 56 |
| AAV CBr-7.4 | 824 | WO2016065001 SEQ ID NO: 57 |
| AAV CBr-7.5 | 825 | WO2016065001 SEQ ID NO: 58 |
| AAV CBr-7.7 | 826 | WO2016065001 SEQ ID NO: 59 |
| AAV CBr-7.8 | 827 | WO2016065001 SEQ ID NO: 60 |
| AAV CBr-7.10 | 828 | WO2016065001 SEQ ID NO: 61 |
| AAV CKd-N3 | 829 | WO2016065001 SEQ ID NO: 62 |
| AAV CKd-N4 | 830 | WO2016065001 SEQ ID NO: 63 |
| AAV CKd-N9 | 831 | WO2016065001 SEQ ID NO: 64 |
| AAV CLv-L4 | 832 | WO2016065001 SEQ ID NO: 65 |
| AAV CLv-L5 | 833 | WO2016065001 SEQ ID NO: 66 |
| AAV CLv-L6 | 834 | WO2016065001 SEQ ID NO: 67 |
| AAV CLv-K1 | 835 | WO2016065001 SEQ ID NO: 68 |
| AAV CLv-K3 | 836 | WO2016065001 SEQ ID NO: 69 |
| AAV CLv-K6 | 837 | WO2016065001 SEQ ID NO: 70 |
| AAV CLv-M1 | 838 | WO2016065001 SEQ ID NO: 71 |
| AAV CLv-M11 | 839 | WO2016065001 SEQ ID NO: 72 |
| AAV CLv-M2 | 840 | WO2016065001 SEQ ID NO: 73 |
| AAV CLv-M5 | 841 | WO2016065001 SEQ ID NO: 74 |
| AAV CLv-M6 | 842 | WO2016065001 SEQ ID NO: 75 |
| AAV CLv-M7 | 843 | WO2016065001 SEQ ID NO: 76 |
| AAV CLv-M8 | 844 | WO2016065001 SEQ ID NO: 77 |
| AAV CLv-M9 | 845 | WO2016065001 SEQ ID NO: 78 |

TABLE 1-continued

AAV Serotypes

| Serotype | SEQ ID NO | Reference Information |
|---|---|---|
| AAV CHt-P1 | 846 | WO2016065001 SEQ ID NO: 79 |
| AAV CHt-P6 | 847 | WO2016065001 SEQ ID NO: 80 |
| AAV CHt-P8 | 848 | WO2016065001 SEQ ID NO: 81 |
| AAV CHt-6.1 | 849 | WO2016065001 SEQ ID NO: 82 |
| AAV CHt-6.10 | 850 | WO2016065001 SEQ ID NO: 83 |
| AAV CHt-6.5 | 851 | WO2016065001 SEQ ID NO: 84 |
| AAV CHt-6.6 | 852 | WO2016065001 SEQ ID NO: 85 |
| AAV CHt-6.7 | 853 | WO2016065001 SEQ ID NO: 86 |
| AAV CHt-6.8 | 854 | WO2016065001 SEQ ID NO: 87 |
| AAV CSp-8.10 | 855 | WO2016065001 SEQ ID NO: 88 |
| AAV CSp-8.2 | 856 | WO2016065001 SEQ ID NO: 89 |
| AAV CSp-8.4 | 857 | WO2016065001 SEQ ID NO: 90 |
| AAV CSp-8.5 | 858 | WO2016065001 SEQ ID NO: 91 |
| AAV CSp-8.6 | 859 | WO2016065001 SEQ ID NO: 92 |
| AAV CSp-8.7 | 860 | WO2016065001 SEQ ID NO: 93 |
| AAV CSp-8.8 | 861 | WO2016065001 SEQ ID NO: 94 |
| AAV CSp-8.9 | 862 | WO2016065001 SEQ ID NO: 95 |
| AAV CBr-B7.3 | 863 | WO2016065001 SEQ ID NO: 96 |
| AAV CBr-B7.4 | 864 | WO2016065001 SEQ ID NO: 97 |
| AAV3B | 865 | WO2016065001 SEQ ID NO: 98 |
| AAV4 | 866 | WO2016065001 SEQ ID NO: 99 |
| AAV5 | 867 | WO2016065001 SEQ ID NO: 100 |
| AAVPHP.B or G2B-26 | 868 | WO2015038958 SEQ ID NO: 8 and 13; GenBankALU85156.1 |
| AAVPHP.B | 869 | WO2015038958 SEQ ID NO: 9 |
| AAVG2B-13 | 870 | WO2015038958 SEQ ID NO: 12 |
| AAVTH1.1-32 | 871 | WO2015038958 SEQ ID NO: 14 |
| AAVTH1.1-35 | 872 | WO2015038958 SEQ ID NO: 15 |

Each of the patents, applications and/or publications listed in Table 1 are hereby incorporated by reference in their entirety.

In one embodiment, the AAV serotype may be, or may have a sequence as described in International Patent Publication WO2015038958, the contents of which are herein incorporated by reference in their entirety, such as, but not limited to, AAV9 (SEQ ID NO: 2 and 11 of WO2015038958 or SEQ ID NO: 127 and 126 respectively herein), PHP.B (SEQ ID NO: 8 and 9 of WO2015038958, herein SEQ ID NO: 868 and 869), G2B-13 (SEQ ID NO: 12 of WO2015038958, herein SEQ ID NO: 870), G2B-26 (SEQ ID NO: 13 of WO2015038958, herein SEQ ID NO: 868 and 869). TH1.1-32 (SEQ ID NO: 14 of WO2015038958, herein SEQ ID NO: 871), TH1.1-3.5 (SEQ ID NO: 15 of WO2015038958, herein SEQ ID NO: 872) or variants thereof. Further, any of the targeting peptides or amino acid inserts described in WO2015038958, May be inserted into any parent AAV serotype, such as, but not limited to, AAV9 (SEQ ID NO: 126 for the DNA sequence and SEQ ID NO: 127 for the amino acid sequence). In one embodiment, the amino acid insert is inserted between amino acids 586-592 of the parent AAV (e.g., AAV9). In another embodiment, the amino acid insert is inserted between amino acids 588-589 of the parent AAV sequence. The amino acid insert may be, but is not limited to, any of the following amino acid sequences, TLAVPFK (SEQ ID NO: 1 of WO2015038958; herein SEQ ID NO: 873), KFPVALT (SEQ ID NO: 3 of WO2015038958; herein SEQ ID NO: 87), LAVPFK (SEQ ID NO: 31 of WO2015038958; herein SEQ ID NO: 875), AVPFK (SEQ ID NO: 32 of WO2015038958; herein SEQ ID NO: 876), VPFK (SEQ ID NO: 33 of WO2015038958; herein SEQ ID NO: 877), TLAVPF (SEQ ID NO: 34 of WO2015038958; herein SEQ ID NO: 878), TLAVP (SEQ ID NO: 35 of WO2015038958; herein SEQ ID NO: 879), TLAV (SEQ ID NO: 36 of WO2015038958; herein SEQ ID NO: 880), SVSKPFL (SEQ ID NO: 28 of WO2015038958; herein SEQ ID NO: 881), FTLTTPK (SEQ ID NO: 29 of WO2015038958; herein SEQ ID NO: 882), MNATKNV (SEQ ID NO: 30 of WO2015038958; herein SEQ ID NO: 883), QSSQTPR (SEC) ID NO: 54 of WO2015038958; herein SEQ ID NO: 884), ILGTGTS (SEQ ID NO: 55 of WO2015038958; herein SEQ ID NO: 885), TRTNPEA (SEQ ID NO: 56 of WO2015038958; herein SEQ ID NO: 886), NGGTSSS (SEQ ID NO: 58 of WO2015038958; herein SEQ ID NO: 887), or YTLSQGW (SEQ ID NO: 60 of WO2015038958; herein SEQ ID NO: 888). Non-limiting examples of nucleotide sequences that may encode the amino acid inserts include the following, AAGTTTCCTGTGGCGTTGACT (for SEQ ID NO: 3 of WO2015038958; herein SEQ ID NO: 889), ACTTTGGCGGTGCCTTTTAAG (SEQ ID NO: 24 and 49 of WO2015038958; herein SEQ ID NO: 890), AGTGTGAGTAAGCCTTTTTG (SEQ ID NO: 25 of WO2015038958; herein SEQ ID NO: 891), TTTACGTTGACGACGCCTAAG (SEQ ID NO: 26 of WO2015038958; herein SEQ ID NO: 892), ATGAATGCTACGAAGAATGTG (SEQ ID NO: 27 of WO2015038958; herein SEQ ID NO: 893), CAGTCGTCGCAGACGCCTAGG (SEQ ID NO: 48 of WO2015038958; herein SEQ ID NO: 894), ATTCTGGGGACTGGTACTTCG (SEQ ID NO: 50 and 52 of WO2015038958, herein SEQ ID NO: 895), ACGCGGACTAATCCTGAGGCT (SEQ ID NO: 51 of WO2015038958; herein SEQ ID NO: 896), AATGGGGGACTAGTAGTTCT (SEQ ID NO: 53 of WO2015038958; herein SEQ ID NO: 89), or TATACTTTGTCGCAGGGTTGG (SEQ ID NO: 59 of WO2015038958, herein SEQ ID NO: 898).

Viral Genome Component: Inverted Terminal Repeats (ITRs)

The AAV particles of the present invention comprise a viral genome with at least one ITR region and a payload region. In one embodiment, the viral genome has two ITRs. These two ITRs flank the payload region at the 5' and 3' ends. The ITRs function as origins of replication comprising recognition sites for replication. ITRs comprise sequence regions which can be complementary and symmetrically arranged. ITRs incorporated into viral genomes of the invention may be comprised of naturally-occurring polynucleotide sequences or recombinantly derived polynucleotide sequences.

The ITRs may be derived from the same serotype as the capsid, selected from any of the serotypes listed in Table 1, or a derivative thereof. The ITR may be of a different serotype than the capsid. In one embodiment, the AAV particle has more than one ITR. In a non-limiting example, the AAV particle has a viral genome comprising two ITRs. In one embodiment, the ITRs are of the same serotype as one another. In another embodiment, the ITRs are of different serotypes. Non-limiting examples include zero, one or both of the ITRs having the same serotype as the capsid. In one embodiment both ITRs of the viral genome of the AAV particle are AAV2 ITRs.

Independently, each ITR may be about 100 to about 150 nucleotides in length. An ITR may be about 100-105 nucleotides in length, 106-110 nucleotides in length, 111-115 nucleotides in length, 116-120 nucleotides in length, 121-125 nucleotides in length, 126-130 nucleotides in length, 131-135 nucleotides in length, 136-140 nucleotides in length, 141-145 nucleotides in length or 146-150 nucleotides in length. In one embodiment, the ITRs are 140-142 nucleotides in length. Non-limiting examples of ITR length are 102, 140, 141, 142, 145 nucleotides in length, and those having at least 95% identity thereto.

Viral Genome Component: Promoters

In one embodiment, the payload region of the viral genome comprises at least one element to enhance the transgene target specificity and expression (See e.g., Powell et al. Viral Expression Cassette Elements to Enhance Transgene Target Specificity and Expression in Gene Therapy, 2015; the contents of which are herein incorporated by reference in its entirety). Non-limiting examples of elements to enhance the transgene target specificity and expression include promoters, endogenous miRNAs, post-transcriptional regulatory elements (PREs), polyadenylation (PolyA) signal sequences and upstream enhancers (USEs), CMV enhancers and introns.

A person skilled in the art may recognize that expression of the poly peptides of the invention in a target cell may require a specific promoter, including but not limited to, a promoter that is species specific, inducible, tissue,-specific, or cell cycle-specific (Parr et al., *Nat. Med.* 3:1145-9 (1997); the contents of which are herein incorporated by reference in their entirety).

In one embodiment, the promoter is deemed to be efficient when it drives expression of the polypeptide(s) encoded in the payload region of the viral genome of the AAV particle.

In one embodiment, the promoter is a promoter deemed to be efficient when it drives expression in the cell being targeted.

In one embodiment, the promoter drives expression of the polypeptides of the invention (e.g., a functional antibody) for a period of time in targeted tissues. Expression driven by a promoter may be for a period of 1 hour, 2, hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 2 days, 3 days, 4 days, 5 days, 6 days, 1 week, 8 days, 9 days, 10 days, 11 days, 12 days, 13 days, 2 weeks, 15 days, 16 days, 17 days, 18 days, 19 days, 20 days, 3 weeks, 22 days, 23 days, 24 days, 25 days, 26 days, 27 days, 28 days, 29 days, 30 days, 31 days, 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 21 months, 22 months, 23 months, 2 years, 3 years, 4 years, 5 years, 6 years, 7 years, 8 years, 9 years, 10 years or more than 10 years. Expression may be for 1-5 hours, 1-12 hours, 1-2 days, 1-.5 days, 1-2 weeks, 1-3 weeks, 1-4 weeks, 1-2 months, 1-4 months, 1-6 months, 2-6 months, 3-6 months, 3-9 months, 4-8 months, 6-12 months, 1-2 years, 1-5 years, 2-5 years, 3-6 years, 3-8 years, 4-8 years or 5-10 years.

In one embodiment, the promoter drives expression of the polypeptides of the invention (e.g., a functional antibody) for at least 1 month, 2 months, 3 months, 4 months, 5 months, 6 months, 7 months, 8 months, 9 months, 10 months, 11 months, 1 year, 2 years, 3 years 4 years, 5 years, 6 years, 7 years, 8 years, 9 years, 10 years, 11 years, 12 years, 13 years, 14 years, 15 years, 16 years, 17 years, 18 years, 19 years, 20 years, 21 years 22 years, 23 years, 24 years, 25 years, 26 years, 27 years, 28 years, 29 years, 30 years, 31 years, 32 years, 33 years, 34 years, 35 years, 36 years, 37 years, 38 years, 39 years, 40 years, 41 years, 42 years, 43 years, 44 years, 45 years, 46 years 47 years, 48 years, 49 years, 50 years, 55 years, 60 years, 65 years, or more than 65 years.

Promoters may be naturally occurring or non-naturally occurring. Non-limiting examples of promoters include viral promoters, plant promoters and mammalian promoters. In some embodiments, the promoters may be human promoters. In some embodiments, the promoter may be truncated.

Promoters which drive or promote expression in most tissues include, but are not limited to, human elongation factor 1α-subunit (EF1α), cytomegalovirus (CMV) immediate-early enhancer and/or promoter, chicken β-actin (CBA) and its derivative CAG, β glucuronidase (GUSB), or ubiquitin C (UBC). Tissue-specific expression elements can be used to restrict expression to certain cell types such as, but not limited to, muscle specific promoters, B cell promoters, monocyte promoters, leukocyte promoters, macrophage promoters, pancreatic acinar cell promoters, endothelial cell promoters, lung tissue promoters, astrocyte promoters, or nervous system promoters which can be used to restrict expression to neurons, astrocytes, or oligodendrocytes.

Non-limiting examples of muscle-specific promoters include mammalian muscle creatine kinase (MCK) promoter, mammalian desmin (DES) promoter, mammalian troponin I (TNNI2) promoter, and mammalian skeletal alpha-actin (ASKA) promoter (see, e.g. U.S. Patent Publication US 20110212529, the contents of which are herein incorporated by reference in their entirety)

Non-limiting examples of tissue-specific expression elements for neurons include neuron-specific enolase (NSE), platelet-derived growth factor (PDGF), platelet-derived growth factor B-chain (PDGF-β), synapsin (Syn), methyl-CpG binding protein 2 (MeCP2), $Ca^{2+}$/calmodulin-dependent protein kinase II (CaMKII), metabotropic glutamate receptor 2 (mGluR2), neurofilament light (NFL) or heavy (NFH), β-globin minigene nβ2, preproenkephalin (PPE), enkephalin (Enk) and excitatory amino acid transporter 2 (EAAT2) promoters. Non-limiting examples of tissue-specific expression elements for astrocytes include glial fibrillary acidic protein (GFAP) and EAAT2 promoters. A non-limiting example of a tissue-specific expression element for oligodendrocytes includes the myelin basic protein (MBP) promoter.

In one embodiment, the promoter may be less than 1 kb. The promoter may have a length of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800 nucleotides. The promoter may have a length between 200-300, 200-400, 200-500, 200-600, 200-700, 200-800, 300-400, 300-500, 300-600, 300-700, 300-800, 400-500, 400-600, 400-700, 400-800, 500-600, 500-700, 500-800 600-700, 600-800 or 700-800.

In one embodiment, the promoter may be a combination of two or more components of the same or different starting or parental promoters such as, hut not limited to, CMV and CBA. Each component may have a length of 200, 210, 220, 230, 240, 250, 260, 270, 280, 290, 300, 310, 320, 330, 340, 350, 360, 370, 380, 381, 382, 383, 384, 385, 386, 387, 388, 389, 390, 400, 410, 420, 430, 440, 450, 469, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800. Each component ma have a length between 200-300, 200-400, 200-500, 200-600 200-700, 200-800, 300-400, 300-500, 300-600, 300-700, 300-800, 499-500, 400-600, 400-700, 400-800, 500-600, 500-700, 500-800, 600-700, 600-800 or 700-800. In one embodiment, the promoter is a combination of a 382 nucleotide CMV-enhancer sequence and a 260 nucleotide CBA-promoter sequence.

In one embodiment, the viral genoine comprises a ubiquitous promoter. Non-limiting examples of ubiquitous promoters include CMV, CBA (including derivatives CAG, CBh, etc.), EF-1α, PGK, UBC, GUSB (hGBp), and UCOE (promoter of HNRPA2B1-CBX3). Yu et al. (Molecular Pain 2011, 7:63; the contents of which are herein incorporated by reference in their entirety) evaluated the expression of eGFP under the CAG, EF1α, PGK and UBC promoters in rat DRG cells and primary DRG cells using lentiviral vectors and found that UBC showed weaker expression than the other 3 promoters and only 10-12% glial expression was seen for all promoters. Soderblom et al. (E. Neuro 2015; the contents of which are herein incorporated by reference in its entirety) evaluated the expression of eGFP AAV8 with CMV and UBC promoters and AAV2 with the CMV promoter after injection in the motor cortex. Intranasal administration of a plasmid containing a UBC or EF1α promoter showed a sustained airway expression greater than the expression with the CMV promoter (See e.g., Gill et al., Gene Therapy 2001, Vol. 8, 1539-1546; the contents of which are herein incorporated by reference in their entirety). Husain et al. (Gene Therapy 2009; the contents of which are herein incorporated by reference in its entirety) evaluated an HβH construct with a hGUSB promoter, a HSV-1 LAT promoter and an NSE promoter and found that the HβH construct showed weaker expression than NSE in mouse brain. Passini and Wolfe (J. Viral. 2001, 12382-12392, the contents of which are herein incorporated by reference in its entirety) evaluated the long-term effects of the HβH vector following an intraventricular injection in neonatal mice and found that there was sustained expression for at least 1 year. Low expression in all brain regions was found by Xu et al. (Gene Therapy 2001, 8, 1323-1332; the contents of which are herein incorporated by reference in their entirety) when NFL and NFH promoters were used as compared to the CMV-lacZ, CMV-luc, EF, GFAP, hENK, nAChR, PPE, PPE+wpre, NSE (0.3 kb), NSF (1.8 kb) and NSE (1.8 kb+wpre). Xu et al. found that the promoter activity in descending order was NSE (1.8 kb), EF, NSE (0.3 kb), GFAP, CMV, hENK, PPE, NFL and NFH. NFL is a 650-nucleotide promoter and NFH is a 920-nucleotide promoter which are both absent in the liver but NFH is abundant in the sensory proprioceptive neurons, brain and spinal cord and NFH is present in the heart. Scn8a is a 470 nucleotide promoter which expresses throughout the DRG, spinal cord and brain with particularly high expression seen in the hippocampal neurons and cerebellar Purkinje cells, cortex, thalamus and hypothalamus (See e.g., Drews et al. *Identification of evolutionary conserved, functional noncoding elements in the promoter region of the sodium channel gene SCN8A*, Mamm Genome (2007) 18:723-731; and Raymond et al. *Expression of Alternatively Spliced Sodium channel a-subunit genes*. Journal of Biological Chemistry (2004) 279(44) 46234-46241; the contents of each of which are herein incorporated by reference in their entireties).

Any of promoters taught by the aforementioned Yu, Soderblom, Gill, Husain, Passini, Xu, Drews or Raymond may be used in the present inventions.

In one embodiment, the promoter is not cell specific.

In one embodiment, the promoter is an ubiquitin c (UBC) promoter. The UBC promoter may have a size of 300-350 nucleotides. As a non-limiting example, the UBC promoter is 332 nucleotides.

In one embodiment, the promoter is a β-glucuronidase (GUSB) promoter. The GUSB promoter may have a size of 350-400 nucleotides. As a non-limiting example, the GUSB promoter is 378 nucleotides.

In one embodiment, the promoter is a neurofilament light (NFL) promoter. The NFL promoter may have a size of 600-700 nucleotides. As a non-limiting example, the NFL promoter is 650 nucleotides.

In one embodiment, the promoter is a neurofilament heavy (NFH) promoter. The NFH promoter may have a size of 900-950 nucleotides. As a non-limiting example, the NFH promoter is 920 nucleotides.

In one embodiment, the promoter is a scn8a promoter. The scn8a promoter may have a size of 450-500 nucleotides. As a non-limiting example, the scn8a promoter is 470 nucleotides.

In one embodiment, the promoter is a phosphoglycerate kinase 1 (PGK) promoter.

In one embodiment, the promoter is a chicken β-actin (CBA) promoter.

In one embodiment, the promoter is a cytomegalovirus (CMV) promoter.

In one embodiment, the promoter is a liver or a skeletal muscle promoter. Non-limiting examples of liver promoters include human α-1-antitrypsin (hAAT) and thyroxine binding globulin (TBG). Non-limiting examples of skeletal muscle promoters include Desmin, MCK or synthetic C5-12.

In one embodiment, the promoter is a RNA pol III promoter. As a non-limiting example, the RNA pol III promoter is U6. As a non-limiting example, the RNA pol III promoter is H1.

In one embodiment, the viral genome comprises two promoters. As a non-limiting example, the promoters are an EF1α promoter and a CMV promoter.

In one embodiment, the viral genome comprises an enhancer element, a promoter and/or a 5'UTR intron. The enhancer element, also referred to herein as an "enhancer," may be, but is not limited to, a CMV enhancer, the promoter may be, but is not limited to, a CMV, CBA, UBC, GUSB, NSF, Synapsin, MeCP2, and GFAP promoter and the 5'UTR/intron may be, but is not limited to, SV40, and CBA-MVM. As a non-limiting example, the enhancer, promoter and/or intron used in combination may be: (1) CMV enhancer, CMV promoter, SV40 5'UTR intron; (2) CMV enhancer, CBA promoter, SV 40 5'UTR intron; (3) CMV enhancer, CBA promoter, CBA-MVM intron, (4) UBC promoter; (5) GUSB promoter; (6) NSF promoter; (7) Synapsin promoter; (8) MeCF2 promoter and (9) GFAP promoter.

In one embodiment, the viral genome comprises an engineered promoter.

In another embodiment, the viral genome comprises a promoter from a naturally expressed protein.

Viral Genome Component: Untranslated Regions (UTRs)

By definition, wild type untranslated regions (UTRs) of a gene are transcribed but not translated. Generally, the 5' UTR starts at the transcription start site and ends at the start codon and the 3' UTR starts immediately following the stop codon and continues until the termination signal for transcription.

Features typically found in abundantly expressed genes of specific target organs may be engineered into UTRs to enhance the stability and protein production. As a non-limiting example, a 5' UTR from mRNA normally expressed in the liver (e.g., albumin, serum amyloid A, Apolipoprotein A/B/E, transferrin, alpha fetoprotein, erythropoietin, or Factor VIII) may be used in the viral genomes of the AAV particles of the invention to enhance expression in hepatic cell lines or liver.

While not wishing to be bound by theory, wild-type 5' untranslated regions (UTRs) include features which play roles in translation initiation. Kozak sequences, which are commonly known to be involved in the process by which the ribosome initiates translation of many genes, are usually included in 5' UTRs. Kozak sequences have the consensus CCR(A/G)CCAUGG, where R is a purine (adenine or guanine) three bases upstream of the start codon (ATG), which is followed by another 'G'.

In one embodiment, the 5'UTR in the viral genome includes a Kozak sequence.

In one embodiment, the 5'UTR in the viral genome does not include a Kozak sequence.

While not wishing to be bound by theory, wild-type 3' UTRs are known to have stretches of Adenosines and Uridines embedded therein. These AU rich signatures are particularly prevalent in genes with high rates of turnover. Based on their sequence features and functional properties, the AU rich elements (AREs) can be separated into three classes (Chen et al, 1995, the contents of which are herein incorporated by reference in its entirety): Class I AREs, such as, but not limited to, c-Myc and MyoD, contain several dispersed copies of an AUUUA motif within U-rich regions. Class II AREs, such as, but not limited to, GM-CSF and TNFa, possess two or more overlapping UUAUUUA(U/A)(U/A) nonamers. Class III ARES, such as, but not limited to, c-Jun and Myogenin, are less well defined. These U rich regions do not contain an AUUUA motif. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of polynucleotides. When engineering specific polynucleotides, e.g., payload regions of viral genomes, one or more copies of an ARE can be introduced to make polynucleotides less stable and thereby curtail translation and decrease production of the resultant protein. Likewise, ARES can be identified and removed or mutated to increase the intracellular stability and thus increase translation and production of the resultant protein.

In one embodiment, the 3' UTR of the viral genome may include an oligo(dT) sequence for templated addition of a poly-A tail.

In one embodiment, the viral genome may include at least one miRNA seed, binding site or full sequence. microRNAs (or miRNA or miR) are 19-25 nucleotide noncoding RNAs that bind to the sites of nucleic acid targets and down-regulate gene expression either by reducing nucleic acid molecule stability or by inhibiting translation. A microRNA sequence comprises a "seed" region, i.e., a sequence in the region of positions 2-8 of the mature microRNA, which sequence has perfect Watson-Crick complementarity to the miRNA target sequence of the nucleic acid.

In one embodiment, the viral genome may be engineered to include, alter or remove at least one miRNA binding site, sequence or seed region.

Any UTR from any gene known in the art may be incorporated into the viral genome of the AAV particle. These UTRs, or portions thereof, may be placed in the same orientation as in the gene from which they were selected or they may be altered in orientation or location. In one embodiment, the UTR used in the viral genome of the AAV particle may be inverted, shortened, lengthened, made with one or more other 5' UTRs or 3' UTRs known in the art. As used herein, the term "altered" as it relates to a UTR, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides.

In one embodiment, the viral genome of the AAV particle comprises at least one artificial UTRs which is not a variant of a wild type UTR.

In one embodiment, the viral genome of the AAV particle comprises UTRs which have been selected from a family of transcripts whose proteins share a common function, structure, feature or property.

Viral Genome Component: Polyadenylation Sequence

In one embodiment, the viral genome of the AAV particles of the present invention comprise at least one polyadenylation sequence. The viral genome of the AAV particle may comprise a polyadenylation sequence between the 3' end of the payload coding sequence and the 5' end of the 3'ITR.

In one embodiment, the polyadenylation sequence or "polyA sequence" may range from absent to about 500 nucleotides in length. The polyadenylation sequence may be, but is not limited to, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 281 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, 488, 489, 490, 491 492, 493, 494, 495, 496, 497, 498, 499 and 500 nucleotides in length.

In one embodiment, the polyadenylation sequence is 50-100 nucleotides in length.

In one embodiment, the polyadenylation sequence is 50-150 nucleotides in length.

In one embodiment, the polyadenylation sequence is 50-160 nucleotides in length.

In one embodiment, the polyadenylation sequence is 50-200 nucleotides in length.

In one embodiment, the polyadenylation sequence is 60-100 nucleotides in length.

In one embodiment, the polyadenylation sequence is 60-150 nucleotides in length.

In one embodiment, the polyadenylation sequence is 60-160 nucleotides in length.

In one embodiment, the polyadenylation sequence is 60-200 nucleotides in length.

In one embodiment, the polyadenylation sequence is 70-100 nucleotides in length.

In one embodiment, the polyadenylation sequence is 70-150 nucleotides in length.

In one embodiment, the polyadenylation sequence is 70-160 nucleotides in length.

In one embodiment, the polyadenylation sequence is 70-200 nucleotides in length.

In one embodiment, the polyadenylation sequence is 80-100 nucleotides in length.

In one embodiment, the polyadenylation sequence is 80-150 nucleotides in length.

In one embodiment, the polyadenylation sequence is 80-160 nucleotides in length.

In one embodiment, the polyadenylation sequence is 80-200 nucleotides in length.

In one embodiment, the polyadenylation sequence is 90-100 nucleotides in length.

In one embodiment, the polyadenylation sequence is 90-150 nucleotides in length.

In one embodiment, the polyadenylation sequence is 90-160 nucleotides in length.

In one embodiment, the polyadenylation sequence is 90-200 nucleotides in length.

Viral Genome Component: Linkers

Viral genomes of the invention may be engineered with one or more spacer or linker regions to separate coding or non-coding regions.

In one embodiment, the payload region of the AAV particle may optionally encode one or more linker sequences. In some cases, the linker may be a peptide linker that may be used to connect the polypeptides encoded by the payload region (i.e., light and heavy antibody chains during expression). Some peptide linkers may be cleaved after expression to separate heavy and light chain domains, allowing assembly of mature antibodies or antibody fragments. Linker cleavage may be enzymatic. In some cases, linkers comprise an enzymatic cleavage site to facilitate intracellular or extracellular cleavage. Some payload regions encode linkers that interrupt polypeptide synthesis during translation of the linker sequence from an mRNA transcript. Such linkers may facilitate the translation of separate protein domains (e.g., heavy and light chain antibody domains) from a single transcript. In some cases, two or more linkers are encoded by a payload region of the viral genome. Non-limiting examples of linkers that may be encoded by the payload region of an AAV particle viral genome are given in Table 2.

TABLE 2

Linkers

| Linker No. | Description | SEQ ID NO or SEQUENCE |
|---|---|---|
| L1 | Internal ribosome entry site (IRES) | 899 |
| L2 | Foot and month disease virus 2A (F2A) | 900 |
| L3 | Porcine teschovirus-1 virus 2A (P2A) | 901 |
| L4 | Furin cleavage site (F) | 902 |
| L5 | 5xG4S ("5xG4S" disclosed as SEQ ID NO: 17939) | 903 |
| L6 | 1,4-alpha-glucan-branching enzyme | CHP |
| L7 | 1,4-alpha-glucan-branching enzyme | 904 |
| L8 | 1,4-beta-N-acetylmuramidase | FKK |
| L9 | 1,4-beta-N-acetylmuramidase | 905 |
| L10 | 1,4-beta-N-acetylmuramidase | 906 |
| L11 | 1,4-beta-N-acetylmuramidase | 907 |
| L12 | 1,4-beta-N-acetylmuramidase | 908 |
| L13 | 1,4-beta-N-acetylmuramidase | 909 |
| L14 | 1,4-beta-N-acetylmuramidase | 910 |
| L15 | 1,4-beta-N-acetylmuramidase | 911 |
| L16 | 1,4-beta-N-acetylmuramidase | 912 |
| L17 | 1,4-beta-N-acetylmuramidase | 913 |
| L18 | 1,4-beta-N-acetylmuramidase | 914 |
| L19 | 150aa long hypothetical transcriptional regulator | 915 |
| L20 | 150aa long hypothetical transcriptional regulator | 916 |
| L21 | 1-deoxy-D-xylulose 5-phosphate reductoisomerase | 917 |
| L22 | 1-deoxy-D-xylulose 5-phosphate reductoisomerase | 918 |
| L23 | 1-deoxy-D-xylulose 5-phosphate reductoisomerase | 919 |
| L24 | 1-deoxy-D-xylulose 5-phosphate reductoisomerase | 920 |
| L25 | 235aa long hypothetical biotin-[acetyl-CoA-carboxylase] ligase | 921 |
| L26 | 235aa long hypothetical biotin-[acetyl-CoA-carboxylase] ligase | 922 |
| L27 | 235aa long hypothetical biotin-[acetyl-CoA-carboxylase] ligase | 923 |
| L28 | 2-dehydropantoate 2-reductase | 924 |
| L29 | 2-dehydropantoate 2-reductase | 925 |
| L30 | 2-dehydropantoate 2-reductase | 926 |
| L31 | 2-dehydropantoate 2-reductase | 927 |
| L32 | 2-dehydropantoate 2-reductase | 928 |

TABLE 2-continued

| Linkers | | |
|---|---|---|
| Linker No. | Description | SEQ ID NO or SEQUENCE |
| L33 | 2-dehydropantoate 2-reductase | 929 |
| L34 | 2-dehydropantoate 2-reductase, putative | 930 |
| L35 | 2-dehydropantoate 2-reductase, putative | 931 |
| L36 | 4-alpha-glucanotransferase | 932 |
| L37 | 4-alpha-glucanotransferase | 933 |
| L38 | 4-alpha-glucanotransferase | 934 |
| L39 | 4-diphosphocytidyl-2C-methyl-D-erythritol kinase | HAA |
| L40 | 4-diphosphocytidyl-2C-methyl-D-erythritol kinase | 935 |
| L41 | 4-diphosphocytidyl-2C-methyl-D-erythritol kinase | 936 |
| L42 | 4-diphosphocytidyl-2C-methyl-D-erythritol kinase | 937 |
| L43 | 4-diphosphocytidyl-2C-methyl-D-erythritol kinase | 938 |
| L44 | 4-hydroxyphenylpyruvate dioxygenase | 939 |
| L45 | 5-13 amino acids from the N termini of human Ck and CH1 domains linker | 940 |
| L46 | 5-13 amino acids from the N termini of human Ck and CH1 domains linker | ERK |
| L47 | 5-13 amino acids from the N termini of human Ck and CH1 domains linker | 941 |
| L48 | 5-13 amino acids from the N termini of human Ck and CH1 domains linker | 942 |
| L49 | 5-13 amino acids from the N termini of human Ck and CH1 domains linker | 943 |
| L50 | 5-13 amino acids from the N termini of human Ck and CH1 domains linker | 944 |
| L51 | 5'-exonuclease | 945 |
| L52 | 5-methyltetrahydropteroyltriglutamate--homocysteinemethyltransferase | ARL |
| L53 | 5-methyltetrahydropteroyltriglutamate--homocysteinemethyltransferase | 946 |
| L54 | 5-methyltetrahydropteroyltriglutamate--homocysteinemethyltransferase | 947 |
| L55 | 5-methyltetrahydropteroyltriglutamate--homocysteinemethyltransferase | 948 |
| L56 | 5-methyltetrahydropteroyltriglutamate--homocysteinemethyltransferase | 949 |
| L57 | 5'-nucleotidase | 950 |
| L58 | 5'-nucleotidase | 951 |
| L59 | 5'-nucleotidase | 952 |
| L60 | 5'-nucleotidase | 953 |
| L61 | 704aa long hypothetical glycosyltransferase | 954 |
| L62 | 704aa long hypothetical glycosyltransferase | 955 |
| L63 | 80 kDa nuclear cap binding protein | 956 |
| L64 | 80 kDa nuclear cap binding protein | 957 |
| L65 | 80 kDa nuclear cap binding protein | 958 |
| L66 | 80 kDa nuclear cap binding protein | 959 |
| L67 | Acetaldehyde dehydrogenase (acylating) | 960 |
| L68 | Acetaldehyde dehydrogenase (acylating) | 961 |
| L69 | Acetolactate synthase isozyme III small subunit | 962 |
| L70 | Acetylcholine receptor protein, alpha chain | 963 |
| L71 | Acetylcholine receptor protein, beta chain | 964 |
| L72 | Aconitate hydratase 2 | 965 |
| L73 | Aconitate hydratase 2 | 966 |
| L74 | Aconitate hydratase 2 | 967 |
| L75 | Aconitate hydratase 2 | 968 |
| L76 | Aconitate hydratase 2 | 969 |
| L77 | Acriflavine resistance protein B | DWY |
| L78 | Acriflavine resistance protein B | GGS |
| L79 | Acriflavine resistance protein B | IDQ |
| L80 | Acriflavine resistance protein B | NKV |
| L81 | Acriflavine resistance protein B | SEA |
| L82 | Acriflavine resistance protein B | 970 |
| L83 | Acriflavine resistance protein B | 971 |
| L84 | Acriflavine resistance protein B | 972 |
| L85 | Acriflavine resistance protein B | 973 |
| L86 | Acriflavine resistance protein B | 974 |
| L87 | Acriflavine resistance protein B | 975 |
| L88 | Acriflavine resistance protein B | 976 |
| L89 | Acriflavine resistance protein B | 977 |
| L90 | Acriflavine resistance protein B | 978 |
| L91 | Acriflavine resistance protein B | 979 |
| L92 | Acriflavine resistance protein B | 980 |
| L93 | Acriflavine resistance protein B | 981 |
| L94 | Acriflavine resistance protein B | 982 |
| L95 | Acriflavine resistance protein B | 983 |
| L96 | Acriflavine resistance protein B | 984 |
| L97 | Acriflavine resistance protein B | 985 |
| L98 | Acriflavine resistance protein B | 986 |
| L99 | Acriflavine resistance protein B | 987 |
| L100 | Acriflavine resistance protein B | 988 |
| L101 | Acriflavine resistance protein B | 989 |
| L102 | Acriflavine resistance protein B | 990 |
| L103 | Acriflavine resistance protein B | 991 |
| L104 | Acriflavine resistance protein B | 992 |
| L105 | Acriflavine resistance protein B | 993 |
| L106 | Acyl-CoA thioesterase II | 994 |
| L107 | Acyl-CoA thioesterase II | 995 |

TABLE 2-continued

Linkers

| Linker No. | Description | SEQ ID NO or SEQUENCE |
|---|---|---|
| L108 | Acyl-CoA thioesterase II | 996 |
| L109 | Acyl-CoA thioesterase II | 997 |
| L110 | Acyl-CoA thioesterase II | 998 |
| L111 | Acyl-coenzyme A thioesterase 4 | 999 |
| L112 | Acyl-coenzyme A thioesterase 4 | 1000 |
| L113 | Acyl-coenzyme A thioesterase 4 | 1001 |
| L114 | Acyl-coenzyme A thioesterase 4 | 1002 |
| L115 | Acyl-coenzyme A thioesterase 4 | 1003 |
| L116 | Adenine glycosylase | 1004 |
| L117 | Adenylate cyclase | 1005 |
| L118 | Aerolysin | 1006 |
| L119 | Aerolysin | 1007 |
| L120 | Agglutinin | DWK |
| L121 | Agglutinin isolectin 1 | 1008 |
| L122 | Agglutinin isolectin 1 | 1009 |
| L123 | Aldehyde ferredoxin oxidoreductase | 1010 |
| L124 | Aldehyde oxidoreductase | 1011 |
| L125 | Aldehyde oxidoreductase | 1012 |
| L126 | Aldehyde oxidoreductase | 1013 |
| L127 | Aldehyde oxidoreductase | 1014 |
| L128 | Aldehyde oxidoreductase | 1015 |
| L129 | Alkyl hydroperoxide reductase subunit F | 1016 |
| L130 | Alkyl hydroperoxide reductase subunit F | 1017 |
| L131 | Alkyl hydroperoxide reductase subunit F | 1018 |
| L132 | Alkyl hydroperoxide reductase subunit F | 1019 |
| L133 | Alkyl hydroperoxide reductase subunit F | 1020 |
| L134 | Alkyl hydroperoxide reductase subunit F | 1021 |
| L135 | Alkyl hydroperoxide reductase subunit F | 1022 |
| L136 | Alkyl hydroperoxide reductase subunit F | 1023 |
| L137 | Alkyl hydroperoxide reductase subunit F | 1024 |
| L138 | Alkyl hydroperoxide reductase subunit F | 1025 |
| L139 | Allantoicase | 1026 |
| L140 | Allantoicase | 1027 |
| L141 | Alliin lyase 1 | SAV |
| L142 | Alliin lyase 1 | 1028 |
| L143 | Alliin lyase 1 | 1029 |
| L144 | Alliin lyase 1 | 1030 |
| L145 | Alliin lyase 1 | 1031 |
| L146 | Alpha amylase | 1032 |
| L147 | Alpha amylase | 1033 |
| L148 | Alpha-actinin 1 | 1034 |
| L149 | Alpha-actinin 1 | 1035 |
| L150 | Alpha-adaptin C | 1036 |
| L151 | Alpha-amylase | 1037 |
| L152 | Alpha-glucuronidase | LSD |
| L153 | Alpha-glucuronidase | 1038 |
| L154 | Alpha-glucuronidase | 1039 |
| L155 | Alpha-glucuronidase | 1040 |
| L156 | Alpha-glucuronidase | 1041 |
| L157 | Alpha-glucuronidase | 1042 |
| L158 | Alpha-glucuronidase | 1043 |
| L159 | Alpha-glucuronidase | 1044 |
| L160 | Alpha-glucuronidase | 1045 |
| L161 | Alpha-glucuronidase | 1046 |
| L162 | Alpha-glucuronidase | 1047 |
| L163 | Alpha-glucuronidase | 1048 |
| L164 | Alpha-glucuronidase | 1049 |
| L165 | Alpha-glucuronidase | 1050 |
| L166 | Alpha-glucuronidase | 1051 |
| L167 | Alpha-glucuronidase | 1052 |
| L168 | Alpha-glucuronidase | 1053 |
| L169 | Alpha-glucuronidase | 1054 |
| L170 | Alpha-glucuronidase | 1055 |
| L171 | Alpha-glucuronidase | 1056 |
| L172 | Alpha-glucuronidase | 1057 |
| L173 | Alpha-glucuronidase | 1058 |
| L174 | Alpha-L-arabinofuranosidase B | 1059 |
| L175 | Alpha-mannosidase | 1060 |
| L176 | Alr2269 protein | 1061 |
| L177 | AMP nucleosidase | 1062 |
| L178 | AMP nucleosidase | 1063 |
| L179 | AMP nucleosidase | 1064 |
| L180 | Angiopoietin-1 receptor | DAG |
| L181 | Angiopoietin-1 receptor | NSG |
| L182 | Angiopoietin-1 receptor | TSA |

TABLE 2-continued

Linkers

| Linker No. | Description | SEQ ID NO or SEQUENCE |
|---|---|---|
| L183 | Angiopoietin-1 receptor | VPR |
| L184 | Angiopoietin-1 receptor | 1065 |
| L185 | Angiopoietin-1 receptor | 1066 |
| L186 | Angiopoietin-1 receptor | 1067 |
| L187 | Angiopoietin-1 receptor | 1068 |
| L188 | Angiopoietin-1 receptor | 1069 |
| L189 | Angiopoietin-1 receptor | 1070 |
| L190 | Angiopoietin-1 receptor | 1071 |
| L191 | Angiopoietin-1 receptor | 1072 |
| L192 | Angiopoietin-1 receptor | 1073 |
| L193 | Angiopoietin-1 receptor | 1074 |
| L194 | Angiopoietin-1 receptor | 1075 |
| L195 | Angiopoietin-1 receptor | 1076 |
| L196 | Angiopoietin-1 receptor | 1077 |
| L197 | Angiopoietin-1 receptor | 1078 |
| L198 | Angiopoietin-1 receptor | 1079 |
| L199 | Angiopoietin-1 receptor | 1080 |
| L200 | Angiopoietin-1 receptor | 1081 |
| L201 | Angiopoietin-1 receptor | 1082 |
| L202 | Angiopoietin-1 receptor | 1083 |
| L203 | Angiopoietin-1 receptor | 1084 |
| L204 | Angiopoietin-1 receptor | 1085 |
| L205 | Annexin A2 | QNK |
| L206 | Annexin A2 | 1086 |
| L207 | Annexin A2 | 1087 |
| L208 | Anthranilate phosphoribosyltransferase | 1088 |
| L209 | AP-2 complex subunit beta-2 | 1089 |
| L210 | Archaeosine tRNA-guanine transglycosylase | LGI |
| L211 | Archaeosine tRNA-guanine transglycosylase | 1090 |
| L212 | Archaeosine tRNA-guanine transglycosylase | 1091 |
| L213 | Archaeosine tRNA-guanine transglycosylase | 1092 |
| L214 | Archaeosine tRNA-guanine transglycosylase | 1093 |
| L215 | Archaeosine tRNA-guanine transglycosylase | 1094 |
| L216 | Archaeosine tRNA-guanine transglycosylase | 1095 |
| L217 | Archaeosine tRNA-guanine transglycosylase | 1096 |
| L218 | Archeal exosome RNA binding protein rrp4 | 1097 |
| L219 | Archeal exosome RNA binding protein rrp4 | 1098 |
| L220 | Archeal exosome RNA binding protein rrp4 | 1099 |
| L221 | Arginyl-tRNA synthetase | IDY |
| L222 | Arginyl-tRNA synthetase | 1100 |
| L223 | Arginyl-tRNA synthetase | 1101 |
| L224 | Arginyl-tRNA synthetase | 1102 |
| L225 | Arrestin | 1103 |
| L226 | Arrestin | 1104 |
| L227 | Arsenite oxidase | 1105 |
| L228 | Artificial linker | PGS |
| L229 | Artificial linker | ATK |
| L230 | Artificial linker | ASK |
| L231 | Artificial linker | 1106 |
| L232 | Artificial linker | 1107 |
| L233 | Artificial linker | 1108 |
| L234 | Artificial linker | 1109 |
| L235 | Artificial linker | 1110 |
| L236 | Artificial linker | 1111 |
| L237 | ATP phosphoribosyltransferase | ANR |
| L238 | ATP-dependent DNA helicase | YDP |
| L239 | ATP-dependent DNA helicase | 1112 |
| L240 | ATP-dependent DNA helicase | 1113 |
| L241 | ATP-dependent DNA helicase | 1114 |
| L242 | ATP-dependent DNA helicase | 1115 |
| L243 | ATP-dependent DNA helicase | 1116 |
| L244 | ATP-dependent DNA helicase | 1117 |
| L245 | ATP-dependent DNA helicase | 1118 |
| L246 | ATP-dependent DNA helicase | 1119 |
| L247 | AT-rich DNA-binding protein | 1120 |
| L248 | AT-rich DNA-binding protein | 1121 |
| L249 | Axonin-1 | DEG |
| L250 | Axonin-1 | ECF |
| L251 | Axonin-1 | 1122 |
| L252 | Axonin-1 | 1123 |
| L253 | Axonin-1 | 1124 |
| L254 | Axonin-1 | 1125 |
| L255 | Axonin-1 | 1126 |
| L256 | Axonin-1 | 1127 |
| L257 | Axonin-1 | 1128 |

TABLE 2-continued

Linkers

| Linker No. | Description | SEQ ID NO or SEQUENCE |
|---|---|---|
| L258 | Bacilysin biosynthesis protein BacB | 1129 |
| L259 | Bacilysin biosynthesis protein BacB | 1130 |
| L260 | Bacilysin biosynthesis protein BacB | 1131 |
| L261 | Bacilysin biosynthesis protein BacB | 1132 |
| L262 | Bacilysin biosynthesis protein BacB | 1133 |
| L263 | Bacteriophage Mu transposase | 1134 |
| L264 | Bacteriophage Mu transposase | 1135 |
| L265 | Benzoyl-CoA-dihydrodiol lyase | 1136 |
| L266 | Benzoyl-CoA-dihydrodiol lyase | 1137 |
| L267 | Benzoyl-CoA-dihydrodiol lyase | 1138 |
| L268 | Benzoyl-CoA-dihydrodiol lyase | 1139 |
| L269 | Benzoyl-CoA-dihydrodiol lyase | 1140 |
| L270 | Benzoylformate decarboxylase | 1141 |
| L271 | Benzoylformate decarboxylase | 1142 |
| L272 | Benzoylformate decarboxylase | 1143 |
| L273 | Beta-amylase | 1144 |
| L274 | Beta-galactosidase | AIS |
| L275 | Beta-galactosidase | 1145 |
| L276 | Beta-galactosidase | 1146 |
| L277 | Beta-galactosidase | 1147 |
| L278 | Beta-galactosidase | 1148 |
| L279 | Beta-galactosidase | 1149 |
| L280 | Beta-galactosidase | 1150 |
| L281 | Beta-galactosidase | 1151 |
| L282 | Beta-galactosidase | 1152 |
| L283 | Beta-galactosidase | 1153 |
| L284 | Beta-galactosidase | 1154 |
| L285 | Beta-galactosidase | 1155 |
| L286 | Beta-galactosidase | 1156 |
| L287 | Beta-galactosidase | 1157 |
| L288 | Beta-galactosidase | 1158 |
| L289 | Beta-galactosidase | 1159 |
| L290 | Beta-galactosidase | 1160 |
| L291 | Beta-galactosidase | 1161 |
| L292 | Beta-galactosidase | 1162 |
| L293 | Beta-galactosidase | 1163 |
| L294 | Beta-galactosidase | 1164 |
| L295 | Beta-galactosidase | 1165 |
| L296 | Beta-galactosidase | 1166 |
| L297 | Beta-N-acetylhexosaminidase | QRE |
| L298 | Beta-N-acetylhexosaminidase | 1167 |
| L299 | Beta-N-acetylhexosaminidase | 1168 |
| L300 | Beta-N-acetylhexosaminidase | 1169 |
| L301 | Bifunctional NMN adenylyltransferase/Nudix hydrolase | 1170 |
| L302 | Bifunctional purine biosynthesis protein PURH | 1171 |
| L303 | Biliverdin reductase A | EHV |
| L304 | Biliverdin reductase A | LME |
| L305 | Biliverdin reductase A | 1172 |
| L306 | Biliverdin reductase A | 1173 |
| L307 | Biodegradative arginine decarboxylase | TVQ |
| L308 | Biodegradative arginine decarboxylase | 1174 |
| L309 | Biodegradative arginine decarboxylase | 1175 |
| L310 | Biodegradative arginine decarboxylase | 1176 |
| L311 | Biodegradative arginine decarboxylase | 1177 |
| L312 | Biodegradative arginine decarboxylase | 1178 |
| L313 | Biodegradative arginine decarboxylase | 1179 |
| L314 | Biodegradative arginine decarboxylase | 1180 |
| L315 | Biodegradative arginine decarboxylase | 1181 |
| L316 | Biodegradative arginine decarboxylase | 1182 |
| L317 | Biodegradative arginine decarboxylase | 1183 |
| L318 | Biodegradative arginine decarboxylase | 1184 |
| L319 | Biodegradative arginine decarboxylase | 1185 |
| L320 | Biotin carboxylase | 1186 |
| L321 | Bowman-Birk trypsin inhibitor | 1187 |
| L322 | Bpt4 gene 59 helicase assembly protein | KQI |
| L323 | BRCA1-associated RING domain protein 1 | 1188 |
| L324 | BRCA1-associated RING domain protein 1 | 1189 |
| L325 | BRCA1-associated RING domain protein 1 | 1190 |
| L326 | Breast cancer 2 | 1191 |
| L327 | Breast cancer 2 | 1192 |
| L328 | Breast cancer 2 | 1193 |
| L329 | Breast cancer 2 | 1194 |
| L330 | Breast cancer 2 | 1195 |
| L331 | Breast cancer 2 | 1196 |
| L332 | Butyrate response factor 2 | 1197 |

TABLE 2-continued

Linkers

| Linker No. | Description | SEQ ID NO or SEQUENCE |
|---|---|---|
| L333 | C4b-binding protein | YKR |
| L334 | C4b-binding protein | 1198 |
| L335 | C5a peptidase | 1199 |
| L336 | C5a peptidase | 1200 |
| L337 | C5a peptidase | 1201 |
| L338 | C5a peptidase | 1202 |
| L339 | C5a peptidase | 1203 |
| L340 | C5a peptidase | 1204 |
| L341 | C5a peptidase | 1205 |
| L342 | C5a peptidase | 1206 |
| L343 | C5a peptidase | 1207 |
| L344 | C5a peptidase | 1208 |
| L345 | C5a peptidase | 1209 |
| L346 | C5a peptidase | 1210 |
| L347 | C5a peptidase | 1211 |
| L348 | Calcium-binding protein | 1212 |
| L349 | CarA | 1213 |
| L350 | CarA | 1214 |
| L351 | Carbamoyl phosphate synthetase (small chain) | 1215 |
| L352 | Carbamoyl phosphate synthetase (small chain) | 1216 |
| L353 | Carbamoyl phosphate synthetase (small chain) | 1217 |
| L354 | Carbamoyl phosphate synthetase (small chain) | 1218 |
| L355 | Carbamoyl phosphate synthetase (small chain) | 1219 |
| L356 | Carbon monoxide dehydrogenase/acetyl-CoA synthase subunitalpha | 1220 |
| L357 | Carboxypeptidase Gp180 residues 503-882 | HRG |
| L358 | Catabolite activation-like protein | 1221 |
| L359 | Catabolite activation-like protein | 1222 |
| L360 | Catechol 2,3-dioxygenase | 1223 |
| L361 | Cation-independent mannose 6-phosphate receptor | 1224 |
| L362 | CD3 epsilon and gamma ectodomain fragment complex | 1225 |
| L363 | CD3 epsilon and gamma ectodomain fragment complex | 1226 |
| L364 | Cell filamentation protein | SNP |
| L365 | Cell filamentation protein | 1227 |
| L366 | Cell filamentation protein | 1228 |
| L367 | Cellular coagulation factor XIII zymogen | DIT |
| L368 | Cellular coagulation factor XIII zymogen | NSD |
| L369 | Cellular coagulation factor XIII zymogen | TDT |
| L370 | Cellular coagulation factor XIII zymogen | 1229 |
| L371 | Cellular coagulation factor XIII zymogen | 1230 |
| L372 | Cellular coagulation factor XIII zymogen | 1231 |
| L373 | Cellular coagulation factor XIII zymogen | 1232 |
| L374 | Cellular coagulation factor XIII zymogen | 1233 |
| L375 | Cellular coagulation factor XIII zymogen | 1234 |
| L376 | Cellular coagulation factor XIII zymogen | 1235 |
| L377 | Cellular coagulation factor XIII zymogen | 1236 |
| L378 | Cellular coagulation factor XIII zymogen | 1237 |
| L379 | Cellular coagulation factor XIII zymogen | 1238 |
| L380 | Cellular coagulation factor XIII zymogen | 1239 |
| L381 | Cellular coagulation factor XIII zymogen | 1240 |
| L382 | Cellular coagulation factor XIII zymogen | 1241 |
| L383 | Cellular coagulation factor XIII zymogen | 1242 |
| L384 | Cellular coagulation factor XIII zymogen | 1243 |
| L385 | Cellular coagulation factor XIII zymogen | 1244 |
| L386 | Cellular coagulation factor XIII zymogen | 1245 |
| L387 | Cellular coagulation factor XIII zymogen | 1246 |
| L388 | Cellular coagulation factor XIII zymogen | 1247 |
| L389 | Cellulase | 1248 |
| L390 | Cellulase | 1249 |
| L391 | Cellulase | 1250 |
| L392 | Cellulase | 1251 |
| L393 | Cellulase | 1252 |
| L394 | Cellulase | 1253 |
| L395 | Cellulase | 1254 |
| L396 | Cellulase | 1255 |
| L397 | Cellulase | 1256 |
| L398 | Cellulase linker | 1257 |
| L399 | Cellulase linker | 1258 |
| L400 | Cellulase linker | 1259 |
| L401 | Cellulase linker | 1260 |
| L402 | Chaperone protein FimC | KLR |
| L403 | Chaperone protein FimC | QAA |
| L404 | Chaperone protein FimC | 1261 |
| L405 | Chaperone protein FimC | 1262 |
| L406 | Chaperone protein HscB | RHP |
| L407 | Chaperone protein HscB | 1263 |

TABLE 2-continued

Linkers

| Linker No. | Description | SEQ ID NO or SEQUENCE |
|---|---|---|
| L408 | CheB methylesterase | 1264 |
| L409 | CheB methylesterase | 1265 |
| L410 | CheB methylesterase | 1266 |
| L411 | Chelatase, putative | 1267 |
| L412 | Chemotaxis receptor methyltransferase cheR | 1268 |
| L413 | Chemotaxis receptor methyltransferase cheR | 1269 |
| L414 | Chemotaxis receptor methyltransferase cheR | 1270 |
| L415 | Cholesterol oxidase | 1271 |
| L416 | Cholesterol oxidase | 1272 |
| L417 | Cholesterol oxidase | 1273 |
| L418 | Cholesterol oxidase | 1274 |
| L419 | Cholesterol oxidase | 1275 |
| L420 | Cholesterol oxidase | 1276 |
| L421 | Cholesterol oxidase | 1277 |
| L422 | Cholesterol oxidase | 1278 |
| L423 | Cholesterol oxidase | 1279 |
| L424 | Cholesterol oxidase | 1280 |
| L425 | Cholesterol oxidase | 1281 |
| L426 | Cholesterol oxidase | 1282 |
| L427 | Chromatin structure-remodeling complex protein RSC4 | KNL |
| L428 | Chromatin structure-remodeling complex protein RSC4 | 1283 |
| L429 | Chromatin structure-remodeling complex protein RSC4 | 1284 |
| L430 | Chromatin structure-remodeling complex protein RSC4 | 1285 |
| L431 | Chromodomain-helicase-DNA-binding protein 1 | 1286 |
| L432 | Chromodomain-helicase-DNA-binding protein 1 | 1287 |
| L433 | Cleavable disulfide | 1288 |
| L434 | Cleavable disulfide | 1289 |
| L435 | Cleavable disulfide | 1290 |
| L436 | Cleavable disulfide | 1291 |
| L437 | Cleavable disulfide | 1292 |
| L438 | Cleavable disulfide | 1293 |
| L439 | Cleavable disulfide | 1294 |
| L440 | Cleavable disulfide | 1295 |
| L441 | Cleavable disulfide | 1296 |
| L442 | Cleavable disulfide | 1297 |
| L443 | Cleavable disulfide | 1298 |
| L444 | Colicin Ia | 1299 |
| L445 | Collagen adhesin | 1300 |
| L446 | Complement C3 beta chain | 1301 |
| L447 | Complement C3 beta chain | 1302 |
| L448 | Complement C3 beta chain | 1303 |
| L449 | Complement C3 beta chain | 1304 |
| L450 | Complement decay-accelerating factor | EIY |
| L451 | Complement factor H | KRP |
| L452 | Complement receptor type 2 | 1305 |
| L453 | Conserved hypothetical protein | 1306 |
| L454 | Conserved hypothetical protein MTH1747 | DIR |
| L455 | Conserved hypothetical protein MTH1747 | 1307 |
| L456 | Conserved hypothetical protein MTH1747 | 1308 |
| L457 | Conserved hypothetical protein MTH1747 | 1309 |
| L458 | Conserved hypothetical protein MTH1747 | 1310 |
| L459 | Conserved hypothetical protein MTH1747 | 1311 |
| L460 | Conserved hypothetical protein MTH1747 | 1312 |
| L461 | Conserved hypothetical protein MTH1747 | 1313 |
| L462 | Conserved protein (MTH177) | 1314 |
| L463 | Creatine amidinohydrolase | 1315 |
| L464 | Cruciferin | 1316 |
| L465 | Cruciferin | 1317 |
| L466 | Cruciferin | 1318 |
| L467 | Cruciferin | 1319 |
| L468 | Cruciferin | 1320 |
| L469 | Cruciferin | 1321 |
| L470 | Cruciferin | 1322 |
| L471 | CSL3 | 1323 |
| L472 | CSL3 | 1324 |
| L473 | CTP synthase | 1325 |
| L474 | CTP synthase | 1326 |
| L475 | Cullin homolog | HKN |
| L476 | Cullin homolog | 1327 |
| L477 | Cullin homolog | 1328 |
| L478 | Cullin homolog | 1329 |
| L479 | Cullin homolog | 1330 |
| L480 | Cullin homolog | 1331 |
| L481 | Cyclin A2 | 1332 |
| L482 | Cysteine-rich secretory protein | 1333 |

TABLE 2-continued

Linkers

| Linker No. | Description | SEQ ID NO or SEQUENCE |
|---|---|---|
| L483 | Cytidine deaminase | 1334 |
| L484 | Cytidine deaminase | 1335 |
| L485 | Cytidine deaminase | 1336 |
| L486 | Cytochrome b-c1 complex subunit Rieske, mitochondrial | 1337 |
| L487 | Cytochrome c oxidase subunit 2 | QAV |
| L488 | Cytochrome c oxidase subunit 2 | 1338 |
| L489 | Cytochrome c oxidase subunit 2 | 1339 |
| L490 | Cytochrome c oxidase subunit 2 | 1340 |
| L491 | Cytochrome c oxidase subunit 2 | 1341 |
| L492 | Cytochrome c4 | GGK |
| L493 | Cytochrome c4 | QGM |
| L494 | D-aminopeptidase | 1342 |
| L495 | DDMC | 1343 |
| L496 | DDMC | 1344 |
| L497 | Deltex protein | 1345 |
| L498 | Deoxyuridine 5'-triphosphate nucleotidohydrolase | 1346 |
| L499 | Diaminopimelate epimerase | 1347 |
| L500 | Diaminopimelate epimerase | 1348 |
| L501 | Diaminopimelate epimerase | 1349 |
| L502 | Di-heme peroxidase | SGC |
| L503 | Di-heme peroxidase | 1350 |
| L504 | Dihydropyrimidine dehydrogenase | 1351 |
| L505 | Dihydropyrimidine dehydrogenase | 1352 |
| L506 | Dihydropyrimidine dehydrogenase | 1353 |
| L507 | Dihydropyrimidine dehydrogenase | 1354 |
| L508 | Dihydropyrimidine dehydrogenase | 1355 |
| L509 | Dihydropyrimidine dehydrogenase | 1356 |
| L510 | Dihydropyrimidine dehydrogenase | 1357 |
| L511 | Dihydropyrimidine dehydrogenase | 1358 |
| L512 | Dihydropyrimidine dehydrogenase | 1359 |
| L513 | Dihydropyrimidine dehydrogenase | 1360 |
| L514 | Dihydropyrimidine dehydrogenase | 1361 |
| L515 | Dihydropyrimidine dehydrogenase | 1362 |
| L516 | Dihydropyrimidine dehydrogenase | 1363 |
| L517 | Dihydropyrimidine dehydrogenase | 1364 |
| L518 | Dihydropyrimidine dehydrogenase | 1365 |
| L519 | Dihydropyrimidine dehydrogenase | 1366 |
| L520 | Dihydropyrimidine dehydrogenase | 1367 |
| L521 | Dihydropyrimidine dehydrogenase | 1368 |
| L522 | Dihydropyrimidine dehydrogenase | 1369 |
| L523 | Dihydropyrimidine dehydrogenase | 1370 |
| L524 | Dihydropyrimidine dehydrogenase | 1371 |
| L525 | Dihydropyrimidine dehydrogenase | 1372 |
| L526 | Dihydropyrimidine dehydrogenase | 1373 |
| L527 | Dihydropyrimidine dehydrogenase | 1374 |
| L528 | Dihydropyrimidine dehydrogenase | 1375 |
| L529 | Dihydropyrimidine dehydrogenase | 1376 |
| L530 | Dihydropyrimidine dehydrogenase | 1377 |
| L531 | Dihydropyrimidine dehydrogenase | 1378 |
| L532 | Dihydropyrimidine dehydrogenase | 1379 |
| L533 | Dihydropyrimidine dehydrogenase | 1380 |
| L534 | Dihydropyrimidine dehydrogenase | 1381 |
| L535 | Discoidin-1 subunit A | 1382 |
| L536 | Discoidin-1 subunit A | 1383 |
| L537 | Discoidin-1 subunit A | 1384 |
| L538 | Dissimilatory copper-containing nitritereductase | 1385 |
| L539 | D-lactate dehydrogenase | DTF |
| L540 | D-lactate dehydrogenase | 1386 |
| L541 | D-lactate dehydrogenase | 1387 |
| L542 | D-lactate dehydrogenase | 1388 |
| L543 | D-lactate dehydrogenase | 1389 |
| L544 | D-lactate dehydrogenase | 1390 |
| L545 | D-lactate dehydrogenase | 1391 |
| L546 | DNA damage-binding protein 1 | LCA |
| L547 | DNA damage-binding protein 1 | 1392 |
| L548 | DNA damage-binding protein 1 | 1393 |
| L549 | DNA damage-binding protein 1 | 1394 |
| L550 | DNA damage-binding protein 1 | 1395 |
| L551 | DNA damage-binding protein 1 | 1396 |
| L552 | DNA damage-binding protein 1 | 1397 |
| L553 | DNA damage-binding protein 1 | 1398 |
| L554 | DNA damage-binding protein 1 | 1399 |
| L555 | DNA damage-binding protein 1 | 1400 |
| L556 | DNA damage-binding protein 1 | 1401 |
| L557 | DNA damage-binding protein 1 | 1402 |

TABLE 2-continued

Linkers

| Linker No. | Description | SEQ ID NO or SEQUENCE |
|---|---|---|
| L558 | DNA damage-binding protein 1 | 1403 |
| L559 | DNA damage-binding protein 1 | 1404 |
| L560 | DNA damage-binding protein 1 | 1405 |
| L561 | DNA damage-binding protein 1 | 1406 |
| L562 | DNA damage-binding protein 1 | 1407 |
| L563 | DNA damage-binding protein 1 | 1408 |
| L564 | DNA damage-binding protein 1 | 1409 |
| L565 | DNA damage-binding protein 1 | 1410 |
| L566 | DNA damage-binding protein 1 | 1411 |
| L567 | DNA damage-binding protein 1 | 1412 |
| L568 | DNA damage-binding protein 1 | 1413 |
| L569 | DNA gyrase B | ALS |
| L570 | DNA gyrase B | 1414 |
| L571 | DNA gyrase B | 1415 |
| L572 | DNA gyrase B | 1416 |
| L573 | DNA gyrase B | 1417 |
| L574 | DNA gyrase B | 1418 |
| L575 | DNA gyrase B | 1419 |
| L576 | DNA gyrase B | 1420 |
| L577 | DNA gyrase B | 1421 |
| L578 | DNA gyrase B | 1422 |
| L579 | DNA gyrase B | 1423 |
| L580 | DNA gyrase B | 1424 |
| L581 | DNA ligase | 1425 |
| L582 | DNA ligase | 1426 |
| L583 | DNA ligase | 1427 |
| L584 | DNA ligase | 1428 |
| L585 | DNA ligase | 1429 |
| L586 | DNA mismatch repair protein MutS | MDA |
| L587 | DNA mismatch repair protein MutS | SII |
| L588 | DNA mismatch repair protein MutS | 1430 |
| L589 | DNA mismatch repair protein MutS | 1431 |
| L590 | DNA mismatch repair protein MutS | 1432 |
| L591 | DNA mismatch repair protein MutS | 1433 |
| L592 | DNA mismatch repair protein MutS | 1434 |
| L593 | DNA polymerase | FSP |
| L594 | DNA polymerase | RQF |
| L595 | DNA polymerase | 1435 |
| L596 | DNA polymerase | 1436 |
| L597 | DNA polymerase | 1437 |
| L598 | DNA polymerase | 1438 |
| L599 | DNA polymerase | 1439 |
| L600 | DNA polymerase | 1440 |
| L601 | DNA polymerase | 1441 |
| L602 | DNA polymerase | 1442 |
| L603 | DNA polymerase alpha subunit B | 1443 |
| L604 | DNA polymerase alpha subunit B | 1444 |
| L605 | DNA polymerase alpha subunit B | 1445 |
| L606 | DNA polymerase alpha subunit B | 1446 |
| L607 | DNA polymerase alpha subunit B | 1447 |
| L608 | DNA polymerase alpha subunit B | 1448 |
| L609 | DNA polymerase alpha subunit B | 1449 |
| L610 | DNA polymerase alpha subunit B | 1450 |
| L611 | DNA polymerase alpha subunit B | 1451 |
| L612 | DNA polymerase alpha subunit B | 1452 |
| L613 | DNA polymerase eta | ALS |
| L614 | DNA polymerase eta | 1453 |
| L615 | DNA polymerase eta | 1454 |
| L616 | DNA polymerase eta | 1455 |
| L617 | DNA polymerase eta | 1456 |
| L618 | DNA polymerase eta | 1457 |
| L619 | DNA polymerase I | AGV |
| L620 | DNA polymerase I | ELE |
| L621 | DNA polymerase I | 1458 |
| L622 | DNA primase | DHK |
| L623 | DNA primase | 1459 |
| L624 | DNA primase | 1460 |
| L625 | DNA primase | 1461 |
| L626 | DNA primase | 1462 |
| L627 | DNA primase | 1463 |
| L628 | DNA primase | 1464 |
| L629 | DNA primase | 1465 |
| L630 | DNA primase/helicase | AGY |
| L631 | DNA primase/helicase | 1466 |
| L632 | DNA primase/helicase | 1467 |

TABLE 2-continued

Linkers

| Linker No. | Description | SEQ ID NO or SEQUENCE |
|---|---|---|
| L633 | DNA primase/helicase | 1468 |
| L634 | DNA primase/helicase | 1469 |
| L635 | DNA primase/helicase | 1470 |
| L636 | DNA primase/helicase | 1471 |
| L637 | DNA primase/helicase | 1472 |
| L638 | DNA primase/helicase | 1473 |
| L639 | DNA primase/helicase | 1474 |
| L640 | DNA primase/helicase | 1475 |
| L641 | DNA topoisomerase 2 | EES |
| L642 | DNA topoisomerase 2 | IPI |
| L643 | DNA topoisomerase 2 | KEL |
| L644 | DNA topoisomerase 2 | 1476 |
| L645 | DNA topoisomerase 2 | 1477 |
| L646 | DNA topoisomerase 2 | 1478 |
| L647 | DNA topoisomerase 2 | 1479 |
| L648 | DNA topoisomerase 2 | 1480 |
| L649 | DNA topoisomerase 2 | 1481 |
| L650 | DNA topoisomerase 2 | 1482 |
| L651 | DNA topoisomerase 2 | 1483 |
| L652 | DNA topoisomerase 2 | 1484 |
| L653 | DNA topoisomerase I | 1485 |
| L654 | DNA topoisomerase I | 1486 |
| L655 | DNA topoisomerase I | 1487 |
| L656 | DNA topoisomerase II, alpha isozyme | PDL |
| L657 | DNA topoisomerase II, alpha isozyme | 1488 |
| L658 | DNA topoisomerase II, alpha isozyme | 1489 |
| L659 | DNA topoisomerase II, alpha isozyme | 1490 |
| L660 | DNA topoisomerase II, alpha isozyme | 1491 |
| L661 | DNA topoisomerase II, alpha isozyme | 1492 |
| L662 | DNA topoisomerase II, alpha isozyme | 1493 |
| L663 | DNA topoisomerase II, alpha isozyme | 1494 |
| L664 | DNA topoisomerase II, alpha isozyme | 1495 |
| L665 | DNA topoisomerase VI A subunit | 1496 |
| L666 | DNA topoisomerase VI A subunit | 1497 |
| L667 | DNA topoisomerase VI A subunit | 1498 |
| L668 | DNA topoisomerase VI A subunit | 1499 |
| L669 | DNA topoisomerase VI A subunit | 1500 |
| L670 | DNA topoisomerase VI A subunit | 1501 |
| L671 | DNA-3-methyladenine glycosylase 2 | 1502 |
| L672 | DNA-binding response regulator MtrA | 1503 |
| L673 | DNA-directed RNA polymerase beta chain | 1504 |
| L674 | DNA-directed RNA polymerase beta chain | 1505 |
| L675 | DNA-directed RNA polymerase beta chain | 1506 |
| L676 | DNA-directed RNA polymerase beta chain | 1507 |
| L677 | DNA-directed RNA polymerase beta chain | 1508 |
| L678 | DNA-directed RNA polymerase beta chain | 1509 |
| L679 | DNA-directed RNA polymerase beta chain | 1510 |
| L680 | DNA-directed RNA polymerase beta chain | 1511 |
| L681 | DNA-directed RNA polymerase II 14.2 kDa polypeptide | 1512 |
| L682 | DNA-directed RNA polymerase II 14.2 kDa polypeptide | 1513 |
| L683 | DNA-directed RNA polymerase, subunit E' (rpoe1) | 1514 |
| L684 | DNA-directed RNA polymerase, subunit E' (rpoe1) | 1515 |
| L685 | DNA-directed RNA polymerases I, II, and III 27 kDa polypeptide | ITP |
| L686 | DNA-directed RNA polymerases I, II, and III 27 kDa polypeptide | 1516 |
| L687 | DNA-directed RNA polymerases I, II, and III 27 kDa polypeptide | 1517 |
| L688 | DNA-directed RNA polymerases I, II, and III 27 kDa polypeptide | 1518 |
| L689 | DNA-directed RNA polymerases I, II, and III 27 kDa polypeptide | 1519 |
| L690 | *Drosophila* neuroglian | 1520 |
| L691 | Dystroglycan | 1521 |
| L692 | Dystrophin | 1522 |
| L693 | Dystrophin | 1523 |
| L694 | Dystrophin | 1524 |
| L695 | Dystrophin | 1525 |
| L696 | Dystrophin | 1526 |
| L697 | Dystrophin | 1527 |
| L698 | Dystrophin | 1528 |
| L699 | E2A DNA-binding protein | 1529 |
| L700 | E2A DNA-binding protein | 1530 |
| L701 | E3 sumo-protein ligase SIZ1 | 1531 |
| L702 | E3 sumo-protein ligase SIZ1 | 1532 |
| L703 | E3 sumo-protein ligase SIZ1 | 1533 |
| L704 | Early switch protein xol-1 2.2k splice form | 1534 |
| L705 | EGF-like module containing mucin-like hormonereceptor-like 2 precursor | 1535 |
| L706 | EGF-like module containing mucin-like hormonereceptor-like 2 precursor | 1536 |
| L707 | Elongation factor 1-gamma 1 | 1537 |

TABLE 2-continued

Linkers

| Linker No. | Description | SEQ ID NO or SEQUENCE |
|---|---|---|
| L708 | Elongation factor 1-gamma 1 | 1538 |
| L709 | Elongation factor g | 1539 |
| L710 | Elongation factor G | 1540 |
| L711 | Elongation factor G | 1541 |
| L712 | Elongation factor G | 1542 |
| L713 | Elongation factor G | 1543 |
| L714 | Elongation factor G | 1544 |
| L715 | Elongation factor G | 1545 |
| L716 | Elongation factor G | 1546 |
| L717 | Elongation factor G | 1547 |
| L718 | Elongation factor G | 1548 |
| L719 | Elongation factor P | 1549 |
| L720 | Elongation factor Ts | 1550 |
| L721 | Elongation factor Ts | 1551 |
| L722 | Elongation factor Ts | 1552 |
| L723 | Elongation factor Tu (ef-Tu) | 1553 |
| L724 | Endoglucanase | 1554 |
| L725 | Endonuclease PI-SceI | 1555 |
| L726 | Endonuclease PI-SceI | 1556 |
| L727 | Endonuclease PI-SceI | 1557 |
| L728 | Endonuclease PI-SceI | 1558 |
| L729 | Endonuclease PI-SceI | 1559 |
| L730 | Endonuclease PI-SceI | 1560 |
| L731 | Endonuclease PI-SceI | 1561 |
| L732 | Endonuclease PI-SceI | 1562 |
| L733 | Endonuclease PI-SceI | 1563 |
| L734 | Enterobactin synthetase component F | 1564 |
| L735 | Enterobactin synthetase component F | 1565 |
| L736 | Enterobactin synthetase component F | 1566 |
| L737 | Enterobactin synthetase component F | 1567 |
| L738 | Enterobactin synthetase component F | 1568 |
| L739 | Enterobactin synthetase component F | 1569 |
| L740 | Enterobactin synthetase component F | 1570 |
| L741 | Enterobactin synthetase component F | 1571 |
| L742 | Enterobactin synthetase component F | 1572 |
| L743 | Enterochelin esterase | 1573 |
| L744 | Epo receptor | EVV |
| L745 | Epo receptor | 1574 |
| L746 | Erythrocyte binding antigen region II | 1575 |
| L747 | Erythrocyte binding antigen region II | 1576 |
| L748 | Erythrocyte binding antigen region II | 1577 |
| L749 | Erythrocyte binding antigen region II | 1578 |
| L750 | Erythrocyte binding antigen region II | 1579 |
| L751 | E-selectin | 1580 |
| L752 | Esterase EstA | SAP |
| L753 | Esterase EstA | 1581 |
| L754 | Esterase EstA | 1582 |
| L755 | Eukaryotic peptide chain release factor GTP-binding subunit | 1583 |
| L756 | Exonuclease I | RQP |
| L757 | Exonuclease I | 1584 |
| L758 | FascIclIn I | SDP |
| L759 | FascIclIn I | 1585 |
| L760 | Fibrillin-1 | 1586 |
| L761 | Fibrillin-1 | 1587 |
| L762 | Fibrillin-1 | 1588 |
| L763 | Fibrillin-1 | 1589 |
| L764 | Fibrillin-1 | 1590 |
| L765 | Fibronectin | 1591 |
| L766 | Fibronectin | 1592 |
| L767 | Fibronectin | 1593 |
| L768 | Flagellar hook protein FlgE | 1594 |
| L769 | Flagellar hook protein FlgE | 1595 |
| L770 | Flagellar hook protein FlgE | 1596 |
| L771 | Flagellar hook protein FlgE | 1597 |
| L772 | Flagellar hook protein FlgE | 1598 |
| L773 | Flagellar hook protein FlgE | 1599 |
| L774 | Flagellar hook protein FlgE | 1600 |
| L775 | Flavohemoprotein | 1601 |
| L776 | Flexible G/S rich linker | G |
| L777 | Flexible G/S rich linker | S |
| L778 | Flexible G/S rich linker | GG |
| L779 | Flexible G/S rich linker | GS |
| L780 | Flexible G/S rich linker | GGS |
| L781 | Flexible G/S rich linker | GGG |
| L782 | Flexible G/S rich linker | 1602 |

TABLE 2-continued

| Linkers | | |
|---|---|---|
| Linker No. | Description | SEQ ID NO or SEQUENCE |
| L783 | Flexible G/S rich linker | 1603 |
| L784 | Flexible G/S rich linker | 1604 |
| L785 | Flexible G/S rich linker | 1605 |
| L786 | Flexible G/S rich linker | 1606 |
| L787 | Flexible G/S rich linker | 1607 |
| L788 | Flexible G/S rich linker | 1608 |
| L789 | Flexible G/S rich linker | 1609 |
| L790 | Flexible G/S rich linker | 1610 |
| L791 | Flexible G/S rich linker | 1611 |
| L792 | Flexible G/S rich linker | 1612 |
| L793 | Flexible G/S rich linker | 1613 |
| L794 | Flexible G/S rich linker | 1614 |
| L795 | Flexible G/S rich linker | 1615 |
| L796 | Focal adhesion kinase 1 | 1616 |
| L797 | FolC bifunctional protein | 1617 |
| L798 | FolC bifunctional protein | 1618 |
| L799 | FolC bifunctional protein | 1619 |
| L800 | FolC bifunctional protein | 1620 |
| L801 | FolC bifunctional protein | 1621 |
| L802 | FolC bifunctional protein | 1622 |
| L803 | FolC bifunctional protein | 1623 |
| L804 | FolC bifunctional protein | 1624 |
| L805 | Follistatin | 1625 |
| L806 | Formate dehydrogenase (large subunit) | YDK |
| L807 | Formate dehydrogenase (large subunit) | 1626 |
| L808 | Formate dehydrogenase (large subunit) | 1627 |
| L809 | Formate dehydrogenase (large subunit) | 1628 |
| L810 | Formate dehydrogenase (large subunit) | 1629 |
| L811 | Formate dehydrogenase (large subunit) | 1630 |
| L812 | Formate dehydrogenase (large subunit) | 1631 |
| L813 | Formate dehydrogenase (large subunit) | 1632 |
| L814 | Formate dehydrogenase (large subunit) | 1633 |
| L815 | Formate dehydrogenase (large subunit) | 1634 |
| L816 | Formate dehydrogenase (large subunit) | 1635 |
| L817 | Formate dehydrogenase (large subunit) | 1636 |
| L818 | Formate dehydrogenase (large subunit) | 1637 |
| L819 | Formate dehydrogenase, nitrate-inducible major subunit | 1638 |
| L820 | Formate dehydrogenase, nitrate-inducible, major subunit | 1639 |
| L821 | Formate dehydrogenase, nitrate-inducible, major subunit | 1640 |
| L822 | Formate dehydrogenase, nitrate-inducible, major subunit | 1641 |
| L823 | Formate dehydrogenase, nitrate-inducible, major subunit | 1642 |
| L824 | Formate dehydrogenase, nitrate-inducible, major subunit | 1643 |
| L825 | Formate dehydrogenase, nitrate-inducible, major subunit | 1644 |
| L826 | Formate dehydrogenase, nitrate-inducible, major subunit | 1645 |
| L827 | Formate dehydrogenase, nitrate-inducible, major subunit | 1646 |
| L828 | Formate dehydrogenase, nitrate-inducible, major subunit | 1647 |
| L829 | Formate dehydrogenase, nitrate-inducible, major subunit | 1648 |
| L830 | Formate dehydrogenase, nitrate-inducible, major subunit | 1649 |
| L831 | Formate dehydrogenase, nitrate-inducible, major subunit | 1650 |
| L832 | Formate dehydrogenase, nitrate-inducible, major subunit | 1651 |
| L833 | Fumarylacetoacetate hydrolase | 1652 |
| L834 | Galactose oxidase | GSV |
| L835 | Galactose oxidase | GWK |
| L836 | Galactose oxidase | IAE |
| L837 | Galactose oxidase | KRQ |
| L838 | Galactose oxidase | QDT |
| L839 | Galactose oxidase | TPN |
| L840 | Galactose oxidase | 1653 |
| L841 | Galactose oxidase | 1654 |
| L842 | Galactose oxidase | 1655 |
| L843 | Galactose oxidase | 1656 |
| L844 | Galactose oxidase | 1657 |
| L845 | Galactose oxidase | 1658 |
| L846 | Galactose oxidase | 1659 |
| L847 | Galactose oxidase | 1660 |
| L848 | Galactose oxidase | 1661 |
| L849 | Galactose oxidase | 1662 |
| L850 | Galactose oxidase | 1663 |
| L851 | Galactose oxidase | 1664 |
| L852 | Galactose oxidase | 1665 |
| L853 | Galactose oxidase | 1666 |
| L854 | Galactose oxidase | 1667 |
| L855 | Galactose oxidase | 1668 |
| L856 | Galactose oxidase | 1669 |
| L857 | Galactose oxidase | 1670 |

TABLE 2-continued

| Linkers | | |
|---|---|---|
| Linker No. | Description | SEQ ID NO or SEQUENCE |
| L858 | Galactose oxidase | 1671 |
| L859 | Galactose oxidase | 1672 |
| L860 | Galactose oxidase | 1673 |
| L861 | Galactose oxidase | 1674 |
| L862 | Galactose oxidase | 1675 |
| L863 | Galactose oxidase | 1676 |
| L864 | Gamma B-crystallin | 1677 |
| L865 | Gamma-delta T-cell receptor | 1678 |
| L866 | Gelation factor | DSS |
| L867 | Gelation factor | 1679 |
| L868 | Gelation factor | 1680 |
| L869 | Gelation factor | 1681 |
| L870 | Gene activator alpha | 1682 |
| L871 | Gingipain R | 1683 |
| L872 | Glucodextranase | 1684 |
| L873 | Glucodextranase | 1685 |
| L874 | Glucodextranase | 1686 |
| L875 | Glucosamine-fructose-6-phosphate aminotransferase | YEQ |
| L876 | Glucosamine-fructose-6-phosphate aminotransferase | 1687 |
| L877 | Glucosamine-fructose-6-phosphate aminotransferase | 1688 |
| L878 | Glucosamine-fructose-6-phosphate aminotransferase | 1689 |
| L879 | Glucosamine-fructose-6-phosphate aminotransferase | 1690 |
| L880 | Glucosamine-fructose-6-phosphate aminotransferase | 1691 |
| L881 | Glucosamine-fructose-6-phosphate aminotransferase | 1692 |
| L882 | Glucosamine-fructose-6-phosphate aminotransferase | 1693 |
| L883 | Glucosamine-fructose-6-phosphate aminotransferase | 1694 |
| L884 | Glucosamine-fructose-6-phosphate aminotransferase | 1695 |
| L885 | Glucosamine-fructose-6-phosphate aminotransferase | 1696 |
| L886 | Glucose-1-phosphate adenylyltransferase small subunit | 1697 |
| L887 | Glucose-1-phosphate adenylyltransferase small subunit | 1698 |
| L888 | Glucose-6-phosphate isomerase | KNA |
| L889 | Glucose-6-phosphate isomerase | VGF |
| L890 | Glucose-6-phosphate isomerase | 1699 |
| L891 | Glucose-6-phosphate isomerase | 1700 |
| L892 | Glucose-6-phosphate isomerase, conjectural | 1701 |
| L893 | Glutamate dehydrogenase | 1702 |
| L894 | Glutamate dehydrogenase | 1703 |
| L895 | Glutamate receptor interacting protein | 1704 |
| L896 | Glutamate synthase [NADPH] large chain | 1705 |
| L897 | Glutamate synthase [NADPH] large chain | 1706 |
| L898 | Glutamate synthase [NADPH] large chain | 1707 |
| L899 | Glutamate synthase [NADPH] large chain | 1708 |
| L900 | Glutamate synthase [NADPH] large chain | 1709 |
| L901 | Glutamate synthase [NADPH] large chain | 1710 |
| L902 | Glutamate synthase [NADPH] large chain | 1711 |
| L903 | Glutamine synthetase | 1712 |
| L904 | Glutamine synthetase | 1713 |
| L905 | Glutamyl-tRNA synthetase | 1714 |
| L906 | Glutamyl-tRNA synthetase | 1715 |
| L907 | Glutamyl-tRNA synthetase | 1716 |
| L908 | Glutamyl-tRNA synthetase | 1717 |
| L909 | Glutamyl-tRNA synthetase | 1718 |
| L910 | Glutamyl-tRNA synthetase | 1719 |
| L911 | Glutamyl-tRNA synthetase | 1720 |
| L912 | Glutamyl-tRNA synthetase | 1721 |
| L913 | Glutaredoxin 2 | 1722 |
| L914 | Glutathione S-transferase | 1723 |
| L915 | Glutathione S-transferase | 1724 |
| L916 | Glutathione S-transferase | 1725 |
| L917 | Glutathione S-transferase 1-6 | 1726 |
| L918 | Glutathione S-transferase A1 | 1727 |
| L919 | Glutathione S-transferase I | NKP |
| L920 | Glutathione S-transferase I | 1728 |
| L921 | Glutathione synthetase | 1729 |
| L922 | Glutathione transferase GST1-4 | 1730 |
| L923 | Glutathione transferase GST1-4 | 1731 |
| L924 | Glutathione transferase sigma class | 1732 |
| L925 | Glycerol-3-phosphate dehydrogenase [NAD(P)+] | 1733 |
| L926 | Glycine cleavage system transcriptionalrepressor, putative | 1734 |
| L927 | Glycolipid-anchored surface protein 2 | 1735 |
| L928 | Glycolipid-anchored surface protein 2 | 1736 |
| L929 | Glycyl-tRNA synthetase | KFA |
| L930 | Glycyl-tRNA synthetase | 1737 |
| L931 | Glycyl-tRNA synthetase | 1738 |
| L932 | Glycyl-tRNA synthetase | 1739 |

TABLE 2-continued

Linkers

| Linker No. | Description | SEQ ID NO or SEQUENCE |
|---|---|---|
| L933 | Glycyl-tRNA synthetase | 1740 |
| L934 | Glycyl-tRNA synthetase | 1741 |
| L935 | Glycyl-tRNA synthetase | 1742 |
| L936 | Glycyl-tRNA synthetase | 1743 |
| L937 | Glycyl-tRNA synthetase | 1744 |
| L938 | Glycyl-tRNA synthetase | 1745 |
| L939 | Growth hormone receptor | 1746 |
| L940 | Growth hormone receptor | 1747 |
| L941 | Harmonin | 1748 |
| L942 | HasR protein | 1749 |
| L943 | HasR protein | 1750 |
| L944 | Hemin transport protein HemS | 1751 |
| L945 | Hemin transport protein HemS | 1752 |
| L946 | Hemin transport protein HemS | 1753 |
| L947 | Hemoglobin | 1754 |
| L948 | Hemolytic lectin CEL-iii | 1755 |
| L949 | Hepatocyte nuclear factor 6 | 1756 |
| L950 | Histidyl-tRNA synthetase | 1757 |
| L951 | HNH homing endonuclease | 1758 |
| L952 | HNH homing endonuclease | 1759 |
| L953 | HNH homing endonuclease | 1760 |
| L954 | Homoserine dehydrogenase | 1761 |
| L955 | Homoserine kinase | 1762 |
| L956 | Homosetine kinase | 1763 |
| L957 | Homoserine kinase | 1764 |
| L958 | Homoserine kinase | 1765 |
| L959 | HTH-type transcriptional regulator MqsA (Ygit/B3021) | 1766 |
| L960 | HTH-type transcriptional repressor YvoA | 1767 |
| L961 | HTH-type transcriptional repressor YvoA | 1768 |
| L962 | Human IgG1 middle hinge linker | 1769 |
| L963 | Human IgG1 upper hinge linker | 1770 |
| L964 | Human IgG3 middle hinge linker | 1771 |
| L965 | Human IgG3m15 middle hinge linker | 1772 |
| L966 | Human IgG4 lower hinge linker | 1773 |
| L967 | Human IgG4 middle hinge linker | 1774 |
| L968 | Human IgG4 upper hinge linker | 1775 |
| L969 | Hybrid cluster protein | 1776 |
| L970 | Hybrid cluster protein | 1777 |
| L971 | Hybrid cluster protein | 1778 |
| L972 | Hybrid cluster protein | 1779 |
| L973 | Hybrid cluster protein | 1780 |
| L974 | Hypothetical conserved protein, GK1056 | 1781 |
| L975 | Hypothetical membrane spanning protein | 1782 |
| L976 | Hypothetical methylmalonyl-CoA decarboxylase alpha subunit | 1783 |
| L977 | Hypothetical methylmalonyl-CoA decarboxylase alpha subunit | 1784 |
| L978 | Hypothetical methylmalonyl-CoA decarboxylase alpha subunit | 1785 |
| L979 | Hypothetical methylmalonyl-CoA decarboxylase alpha subunit | 1786 |
| L980 | Hypothetical methylmalonyl-CoA decarboxylase alpha subunit | 1787 |
| L981 | Hypothetical methylmalonyl-CoA decarboxylase alpha subunit | 1788 |
| L982 | Hypothetical methylmalonyl-CoA decarboxylase alpha subunit | 1789 |
| L983 | Hypothetical protein | AEP |
| L984 | Hypothetical protein | 1790 |
| L985 | Hypothetical protein APE0525 | PTL |
| L986 | Hypothetical protein APE0525 | 1791 |
| L987 | Hypothetical protein LOC449832 | 1792 |
| L988 | Hypothetical protein LOC449832 | 1793 |
| L989 | Hypothetical protein PA4388 | 1794 |
| L990 | Hypothetical protein PA5201 | ASE |
| L991 | Hypothetical protein PA5201 | QDP |
| L992 | Hypothetical protein PA5201 | VKL |
| L993 | Hypothetical protein PA5201 | 1795 |
| L994 | Hypothetical protein PA5201 | 1796 |
| L995 | Hypothetical protein PA5201 | 1797 |
| L996 | Hypothetical protein PA5201 | 1798 |
| L997 | Hypothetical protein PA5201 | 1799 |
| L998 | Hypothetical protein PA5201 | 1800 |
| L999 | Hypothetical protein PA5201 | 1801 |
| L1000 | Hypothetical protein PA5201 | 1802 |
| L1001 | Hypothetical protein PA5201 | 1803 |
| L1002 | Hypothetical protein PA5201 | 1804 |
| L1003 | Hypothetical protein PA5201 | 1805 |
| L1004 | Hypothetical protein PA5201 | 1806 |
| L1005 | Hypothetical protein PA5201 | 1807 |
| L1006 | Hypothetical protein PA5201 | 1808 |
| L1007 | Hypothetical protein PA5201 | 1809 |

TABLE 2-continued

Linkers

| Linker No. | Description | SEQ ID NO or SEQUENCE |
|---|---|---|
| L1008 | Hypothetical protein PA5201 | 1810 |
| L1009 | Hypothetical protein PA5201 | 1811 |
| L1010 | Hypothetical protein PA5201 | 1812 |
| L1011 | Hypothetical protein PA5201 | 1813 |
| L1012 | Hypothetical protein PA5201 | 1814 |
| L1013 | Hypothetical protein PH0495 | ASN |
| L1014 | Hypothetical protein PH0495 | 1815 |
| L1015 | Hypothetical protein PH0495 | 1816 |
| L1016 | Hypothetical protein PH0495 | 1817 |
| L1017 | Hypothetical protein PH0495 | 1818 |
| L1018 | Hypothetical protein PH0510 | 1819 |
| L1019 | Hypothetical protein PH0510 | 1820 |
| L1020 | Hypothetical protein PH1313 | 1821 |
| L1021 | Hypothetical protein PH1313 | 1822 |
| L1022 | Hypothetical protein SLR0953 | 1823 |
| L1023 | Hypothetical protein SLR0953 | 1824 |
| L1024 | Hypothetical protein SLR0953 | 1825 |
| L1025 | Hypothetical protein SLR0953 | 1826 |
| L1026 | Hypothetical protein SLR0953 | 1827 |
| L1027 | Hypothetical protein YIGZ | 1828 |
| L1028 | Hypothetical protein YIGZ | 1829 |
| L1029 | Hypothetical protein YJIA | 1830 |
| L1030 | Hypothetical protein YJIA | 1831 |
| L1031 | Hypothetical protein YJIA | 1832 |
| L1032 | Hypothetical protein YJIA | 1833 |
| L1033 | Hypothetical protein YJIA | 1834 |
| L1034 | Hypothetical tRNA/rRNA methyltransferase YJFH | 1835 |
| L1035 | Hypothetical tRNA/rRNA methyltransferase YJFH | 1836 |
| L1036 | IclR transcriptional regulator | 1837 |
| L1037 | IclR transcriptional regulator | 1838 |
| L1038 | IclR transcriptional regulator | 1839 |
| L1039 | IclR transcriptional regulator | 1840 |
| L1040 | Integrase | 1841 |
| L1041 | Interferon, alpha-inducible protein (clone IFI-15k) | 1842 |
| L1042 | Interleukin-1 receptor, type I | AIF |
| L1043 | Interleukin-1 receptor, type I | 1843 |
| L1044 | Interleukin-1 receptor, type I | 1844 |
| L1045 | Interleukin-1 receptor, type I | 1845 |
| L1046 | Interleukin-12 subunit p40 | FFI |
| L1047 | Interleukin-12 subunit p40 | 1846 |
| L1048 | Interleukin-12 subunit p40 | 1847 |
| L1049 | Interleukin-12 subunit p40 | 1848 |
| L1050 | Interleukin-12 subunit p40 | 1849 |
| L1051 | Interleukin-12 subunit p40 | 1850 |
| L1052 | lnterleukin-12 subunit p40 | 1851 |
| L1053 | Interleukin-12 subunit p40 | 1852 |
| L1054 | Interleukin-2 receptor alpha chain | 1853 |
| L1055 | Interleukin-2 receptor alpha chain | 1854 |
| L1056 | Internalin B | VTQ |
| L1057 | Internalin B | 1855 |
| L1058 | Internalin B | 1856 |
| L1059 | Internalin B | 1857 |
| L1060 | Internalin B | 1858 |
| L1061 | Internalin B | 1859 |
| L1062 | Internalin B | 1860 |
| L1063 | Internalin B | 1861 |
| L1064 | Internalin B | 1862 |
| L1065 | Internalin B | 1863 |
| L1066 | Internalin B | 1864 |
| L1067 | Internalin B | 1865 |
| L1068 | Internalin B | 1866 |
| L1069 | Intimin | SLV |
| L1070 | Intimin | 1867 |
| L1071 | Intimin | 1868 |
| L1072 | Intimin | 1869 |
| L1073 | Intron-encoded DNA endonuclease I-anil | 1870 |
| L1074 | Intron-encoded DNA endonuclease I-anil | 1871 |
| L1075 | Invasin | KST |
| L1076 | Invasin | 1872 |
| L1077 | Invasin | 1873 |
| L1078 | Invasin | 1874 |
| L1079 | Invasin | 1875 |
| L1080 | Invasin | 1876 |
| L1081 | Invasin | 1877 |
| L1082 | Invasin | 1878 |

TABLE 2-continued

Linkers

| Linker No. | Description | SEQ ID NO or SEQUENCE |
|---|---|---|
| L1083 | Invasin | 1879 |
| L1084 | Invasin | 1880 |
| L1085 | Invasin | 1881 |
| L1086 | Invasin | 1882 |
| L1087 | Invasin | 1883 |
| L1088 | Iron hydrogenase 1 | GAE |
| L1089 | Iron hydrogenase 1 | 1884 |
| L1090 | Iron hydrogenase 1 | 1885 |
| L1091 | Iron hydrogenase 1 | 1886 |
| L1092 | Iron hydrogenase 1 | 1887 |
| L1093 | Iron hydrogenase 1 | 1888 |
| L1094 | Iron hydrogenase 1 | 1889 |
| L1095 | Iron hydrogenase 1 | 1890 |
| L1096 | Iron hydrogenase 1 | 1891 |
| L1097 | Iron hydrogenase 1 | 1892 |
| L1098 | Iron hydrogenase 1 | 1893 |
| L1099 | Iron hydrogenase 1 | 1894 |
| L1100 | Iron hydrogenase 1 | 1895 |
| L1101 | Iron hydrogenase 1 | 1896 |
| L1102 | Iron transport protein | 1897 |
| L1103 | Isoflavanone 4'-O-methyltransferase | 1898 |
| L1104 | Isoflavanone 4'-O-methyltransferase | 1899 |
| L1105 | Junctional adhesion molecule 1 | 1900 |
| L1106 | Junctional adhesion molecule 1 | 1901 |
| L1107 | Junctional adhesion molecule 1 | 1902 |
| L1108 | Kanamycin nucleotidyltransferase | 1903 |
| L1109 | Kanamycin nucleotidyltransferase | 1904 |
| L1110 | Kanamycin nucleotidyltransferase | 1905 |
| L1111 | Kanamycin nucleotidyltransferase | 1906 |
| L1112 | Kelch-like protein 11 | 1907 |
| L1113 | Kexin | ISE |
| L1114 | Kexin | 1908 |
| L1115 | Kexin | 1909 |
| L1116 | Kexin | 1910 |
| L1117 | Kexin | 1911 |
| L1118 | Kexin | 1912 |
| L1119 | Kexin | 1913 |
| L1120 | Kexin | 1914 |
| L1121 | Ku70 | 1915 |
| L1122 | Ku70 | 1916 |
| L1123 | Ku70 | 1917 |
| L1124 | Ku70 | 1918 |
| L1125 | Ku80 | 1919 |
| L1126 | Laccase-1 | 1920 |
| L1127 | Laccase-1 | 1921 |
| L1128 | Laccase-1 | 1922 |
| L1129 | Laccase-1 | 1923 |
| L1130 | Laminin | DKC |
| L1131 | L-aspartate dehydrogenase | SAS |
| L1132 | L-aspartate dehydrogenase | 1924 |
| L1133 | L-aspartate dehydrogenase | 1925 |
| L1134 | Leucine dehydrogenase | 1926 |
| L1135 | Leucine dehydrogenase | 1927 |
| L1136 | Light chain of HyHel10 antibody fragment (fab) | 1928 |
| L1137 | Lin2111 protein | 1929 |
| L1138 | Lin2111 protein | 1930 |
| L1139 | Lipopolysaccharide-responsive and beige-like anchor protein | 1931 |
| L1140 | Lipopolysaccharide-responsive and beige-like anchor protein | 1932 |
| L1141 | Lipovitellin (LV-1N, LV-1C) | 1933 |
| L1142 | Lipovitellin (LV-1N, LV-1C) | 1934 |
| L1143 | Lipovitellin (LV-1N, LV-1C) | 1935 |
| L1144 | Lipovitellin (LV-1N, LV-1C) | 1936 |
| L1145 | Lipovitellin (LV-1N, LV-1C) | 1937 |
| L1146 | Lipoxygenase-1 | 1938 |
| L1147 | Lipoxygenase-1 | 1939 |
| L1148 | Low affinity immunoglobulin gamma Fc region receptor II-A | 1940 |
| L1149 | Luciferase | 1941 |
| L1150 | LysR-type regulatory protein | 1942 |
| L1151 | Macrolide-specific efflux protein MacA | ATE |
| L1152 | Macrolide-specific efflux protein MacA | 1943 |
| L1153 | Macrolide-specific efflux protein MacA | 1944 |
| L1154 | Magnesium transporter, putative | 1945 |
| L1155 | Main hemagglutinin component | 1946 |
| L1156 | Major centromere autoantigen B | 1947 |
| L1157 | Major surface antigen p30 | 1948 |

TABLE 2-continued

Linkers

| Linker No. | Description | SEQ ID NO or SEQUENCE |
|---|---|---|
| L1158 | Major surface antigen p30 | 1949 |
| L1159 | Major vault protein | 1950 |
| L1160 | Major vault protein | 1951 |
| L1161 | Maltose phosphorylase | 1952 |
| L1162 | Maltose phosphorylase | 1953 |
| L1163 | Maltose phosphorylase | 1954 |
| L1164 | Maltose phosphorylase | 1955 |
| L1165 | Maltose phosphorylase | 1956 |
| L1166 | Manganese-dependent inorganic pyrophosphatase | 1957 |
| L1167 | Manganese-dependent inorganic pyrophosphatase | 1958 |
| L1168 | Mannan-binding lectin | 1959 |
| L1169 | Mannan-binding lectin | 1960 |
| L1170 | Mannan-binding lectin | 1961 |
| L1171 | Mannitol dehydrogenase | HNA |
| L1172 | Mannitol dehydrogenase | 1962 |
| L1173 | Membrane cofactor protein | RET |
| L1174 | Membrane cofactor protein | 1963 |
| L1175 | Membrane-associated prostaglandin E synthase-2 | 1964 |
| L1176 | Membrane-associated prostaglandin E synthase-2 | 1965 |
| L1177 | Membrane-associated prostaglandin E synthase-2 | 1966 |
| L1178 | Membrane-associated prostaglandin E synthase-2 | 1967 |
| L1179 | Membrane-associated prostaglandin E synthase-2 | 1968 |
| L1180 | Membrane-bound lytic murein transglycosylase A | 1969 |
| L1181 | Methionyl-tRNA synthetase | 1970 |
| L1182 | Methyl-accepting chemotaxis protein | VRP |
| L1183 | Methyl-accepting chemotaxis protein | 1971 |
| L1184 | Methyl-accepting chemotaxis protein | 1972 |
| L1185 | Methyl-accepting chemotaxis protein | 1973 |
| L1186 | Methyl-coenzyme M reductase | 1974 |
| L1187 | Methyl-coenzyme M reductase | 1975 |
| L1188 | Methyl-coenzyme M reductase | 1976 |
| L1189 | Methyl-coenzyme M reductase | 1977 |
| L1190 | Methylene tetrahydromethanopterin dehydrogenase | 1978 |
| L1191 | Methylene tetrahydromethanopterin dehydrogenase | 1979 |
| L1192 | Mg2+ transporter MgtE | 1980 |
| L1193 | Mg2+ transporter MgtE | 1981 |
| L1194 | Mg2+ transporter MgtE | 1982 |
| L1195 | Mitochondrial aconitase | 1983 |
| L1196 | Mitochondrial aconitase | 1984 |
| L1197 | Modification methylase TaqI | EGK |
| L1198 | Modification methylase TaqI | PAT |
| L1199 | Modification methylase TaqI | 1985 |
| L1200 | Modification methylase TaqI | 1986 |
| L1201 | Modification methylase TaqI | 1987 |
| L1202 | Modification methylase TaqI | 1988 |
| L1203 | Modification methylase TaqI | 1989 |
| L1204 | Modification methylase TaqI | 1990 |
| L1205 | Modification methylase TaqI | 1991 |
| L1206 | Modification methylase TaqI | 1992 |
| L1207 | Multidrug-efflux transporter 1 regulator | 1993 |
| L1208 | Muramoyl-pentapeptide carboxypeptidase | 1994 |
| L1209 | MutL | 1995 |
| L1210 | MutL | 1996 |
| L1211 | MutL | 1997 |
| L1212 | MutL | 1998 |
| L1213 | MutL | 1999 |
| L1214 | MutL | 2000 |
| L1215 | MutL | 2001 |
| L1216 | MutL | 2002 |
| L1217 | MutL | 2003 |
| L1218 | MutM (Fpg) protein | 2004 |
| L1219 | MutM (Fpg) protein | 2005 |
| L1220 | MutM (Fpg) protein | 2006 |
| L1221 | MutM (Fpg) protein | 2007 |
| L1222 | Myotubularin-related protein 2 | THW |
| L1223 | Myotubularin-related protein 2 | 2008 |
| L1224 | Myotubularin-related protein 2 | 2009 |
| L1225 | Myotubularin-related protein 2 | 2010 |
| L1226 | Myotubularin-related protein 2 | 2011 |
| L1227 | Myotubularin-related protein 2 | 2012 |
| L1228 | N utilization substance protein A | EIP |
| L1229 | N utilization substance protein A | 2013 |
| L1230 | N utilization substance protein A | 2014 |
| L1231 | N utilization substance protein A | 2015 |
| L1232 | N-acetylglucosamine kinase | CAY |

TABLE 2-continued

Linkers

| Linker No. | Description | SEQ ID NO or SEQUENCE |
|---|---|---|
| L1233 | N-acetylglucosamine kinase | ISP |
| L1234 | N-acetylglucosamine kinase | 2016 |
| L1235 | N-acyl-D-glutamate deacylase | 2017 |
| L1236 | N-acyl-D-glutamate deacylase | 2018 |
| L1237 | N-acyl-D-glutamate deacylase | 2019 |
| L1238 | N-acyl-D-glutamate deacylase | 2020 |
| L1239 | N-acyl-D-glutamate deacylase | 2021 |
| L1240 | N-acyl-D-glutamate deacylase | 2022 |
| L1241 | N-acyl-D-glutamate deacylase | 2023 |
| L1242 | NAD-dependent malic enzyme | 2024 |
| L1243 | NAD-dependent malic enzyme | 2025 |
| L1244 | NADH peroxidase | ADT |
| L1245 | NADH peroxidase | AVG |
| L1246 | NADH peroxidase | TLI |
| L1247 | NADH peroxidase | 2026 |
| L1248 | NADH peroxidase | 2027 |
| L1249 | NADH peroxidase | 2028 |
| L1250 | NADH peroxidase | 2029 |
| L1251 | NADH peroxidase | 2030 |
| L1252 | NADH peroxidase | 2031 |
| L1253 | NADH pyrophosphatase | 2032 |
| L1254 | Naphthalene 1,2-dioxygenase alpha subunit | 2033 |
| L1255 | Naphthalene 1,2-dioxygenase alpha subunit | 2034 |
| L1256 | NEDD8-activating enzyme E1 catalytic subunit | 2035 |
| L1257 | NEDD8-activating enzyme E1 regulatory subunit | 2036 |
| L1258 | NEDD8-activating enzyme E1 regulatory subunit | 2037 |
| L1259 | NEDD8-activating enzyme E1 regulatory subunit | 2038 |
| L1260 | Nei endonuclease VIII-Like 1 | 2039 |
| L1261 | Nei endonuclease VIII-Like 1 | 2040 |
| L1262 | Nei endonuclease VIII-Like 1 | 2041 |
| L1263 | Nei endonuclease VIII-Like 1 | 2042 |
| L1264 | Neural cell adhesion molecule 2 | 2043 |
| L1265 | Neural cell adhesion molecule 2 | 2044 |
| L1266 | Neural cell adhesion molecule 2 | 2045 |
| L1267 | Neural cell adhesion molecule 2 | 2046 |
| L1268 | Neural cell adhesion molecule 2 | 2047 |
| L1269 | Neuroplastin | 2048 |
| L1270 | Neuroplastin | 2049 |
| L1271 | Neuroplastin | 2050 |
| L1272 | Neutrophil cytosol factor 1 | 2051 |
| L1273 | Nickel responsive regulator | 2052 |
| L1274 | NifU-like protein 2, chloroplast | 2053 |
| L1275 | Nitric oxide reductase | ILM |
| L1276 | Nitric oxide reductase | 2054 |
| L1277 | Nitric oxide reductase | 2055 |
| L1278 | Nitric oxide reductase | 2056 |
| L1279 | Nitric oxide reductase | 2057 |
| L1280 | Nitric oxide reductase | 2058 |
| L1281 | NK receptor | 2059 |
| L1282 | Nuclear factor of activated t-cells, cytoplasmic2 | 2060 |
| L1283 | Nucleolin RBD12 | 2061 |
| L1284 | O-GlcNAcase NagJ | 2062 |
| L1285 | Orange carotenoid protein | EGV |
| L1286 | Orange carotenoid protein | 2063 |
| L1287 | Orange carotenoid protein | 2064 |
| L1288 | Orn/Lys/Arg decarboxylase family protein | LEL |
| L1289 | Orn/Lys/Arg decarboxylase family protein | 2065 |
| L1290 | Orn/Lys/Arg decarboxylase family protein | 2066 |
| L1291 | Orn/Lys/Arg decarboxylase family protein | 2067 |
| L1292 | Orn/Lys/Arg decarboxylase family protein | 2068 |
| L1293 | Orn/Lys/Arg decarboxylase family protein | 2069 |
| L1294 | Orn/Lys/Arg decarboxylase family protein | 2070 |
| L1295 | Orn/Lys/Arg decarboxylase family protein | 2071 |
| L1296 | Osteoclast-stimulating factor 1 | 2072 |
| L1297 | Oxygen-independent coproporphyrinogen III oxidase | 2073 |
| L1298 | Oxygen-independent coproporphyrinogen III oxidase | 2074 |
| L1299 | Oxygen-independent coproporphyrinogen III oxidase | 2075 |
| L1300 | Oxygen-independent coproporphyrinogen III oxidase | 2076 |
| L1301 | Oxygen-independent coproporphyrinogen III oxidase | 2077 |
| L1302 | Oxygen-independent coproporphyrinogen III oxidase | 2078 |
| L1303 | Oxygen-independent coproporphyrinogen III oxidase | 2079 |
| L1304 | Oxygen-independent coproporphyrinogen III oxidase | 2080 |
| L1305 | Oxygen-independent coproporphyrinogen III oxidase | 2081 |
| L1306 | Oxygen-independent coproporphyrinogen III oxidase | 2082 |
| L1307 | Paraneoplastic encephalomyelitis antigen HuD | 2083 |

TABLE 2-continued

Linkers

| Linker No. | Description | SEQ ID NO or SEQUENCE |
|---|---|---|
| L1308 | Paraneoplastic encephalomyelitis antigen HuD | 2084 |
| L1309 | Penicillin binding protein 4 | 2085 |
| L1310 | Penicillin binding protein 4 | 2086 |
| L1311 | Penicillin binding protein 4 | 2087 |
| L1312 | Penicillin binding protein 4 | 2088 |
| L1313 | Penicillin binding protein 4 | 2089 |
| L1314 | Penicillin binding protein 4 | 2090 |
| L1315 | Penicillin binding protein 4 | 2091 |
| L1316 | Peptide-N(4)-(N-acetyl-beta-D-glucosaminyl)asparagine amidase F | DGV |
| L1317 | Peptide-N(4)-(N-acetyl-beta-D-glucosaminyl)asparagine amidase F | 2092 |
| L1318 | Peptide-N(4)-(N-acetyl-beta-D-glucosaminyl)asparagine amidase F | 2093 |
| L1319 | Peptide-N(4)-(N-acetyl-beta-D-glucosaminyl)asparagine amidase F | 2094 |
| L1320 | Peroxisomal primary amine oxidase | 2095 |
| L1321 | Peroxisomal primary amine oxidase | 2096 |
| L1322 | Peroxisome biogenesis factor 1 | 2097 |
| L1323 | Pesticidial crystal protein Cry2Aa | 2098 |
| L1324 | Pesticidial crystal protein Cry2Aa | 2099 |
| L1325 | Pesticidial crystal protein Cry2Aa | 2100 |
| L1326 | Phase 1 flagellin | DLT |
| L1327 | Phase 1 flagellin | 2101 |
| L1328 | Phase 1 flagellin | 2102 |
| L1329 | Phase 1 flagellin | 2103 |
| L1330 | Phase 1 flagellin | 2104 |
| L1331 | Phase 1 flagellin | 2105 |
| L1332 | Phase 1 flagellin | 2106 |
| L1333 | Phase 1 flagellin | 2107 |
| L1334 | Phase 1 flagellin | 2108 |
| L1335 | Phase 1 flagellin | 2109 |
| L1336 | Phase 1 flagellin | 2110 |
| L1337 | Phase 1 flagellin | 2111 |
| L1338 | Phase 1 flagellin | 2112 |
| L1339 | Phenylalanyl-tRNA synthetase beta chain | LGL |
| L1340 | Phenylalanyl-tRNA synthetase beta chain | 2113 |
| L1341 | Phenylalanyl-tRNA synthetase beta chain | 2114 |
| L1342 | Phenylalanyl-tRNA synthetase beta chain | 2115 |
| L1343 | Phenylalanyl-tRNA synthetase beta chain | 2116 |
| L1344 | Phenylalanyl-tRNA synthetase beta chain | 2117 |
| L1345 | Phenylalanyl-tRNA synthetase beta chain | 2118 |
| L1346 | Phenylalanyl-tRNA synthetase beta chain | 2119 |
| L1347 | Phenylalanyl-tRNA synthetase beta chain | 2120 |
| L1348 | Phenylalanyl-tRNA synthetase beta chain | 2121 |
| L1349 | Phenylalanyl-tRNA synthetase beta chain | 2122 |
| L1350 | Phenylalanyl-tRNA synthetase beta chain | 2123 |
| L1351 | Phenylalanyl-tRNA synthetase beta chain | 2124 |
| L1352 | Phenylalanyl-tRNA synthetase beta chain | 2125 |
| L1353 | Phosphatase | 2126 |
| L1354 | Phosphatase | 2127 |
| L1355 | Phosphatase | 2128 |
| L1356 | Phosphatidylinositol transfer protein Sec14p | YGT |
| L1357 | Phosphatidylinositol transfer protein Sec14p | 2129 |
| L1358 | Phosphatidylinositol transfer protein Sec14p | 2130 |
| L1359 | Phosphatidylserine synthase | 2131 |
| L1360 | Phosphatidylserine synthase | 2132 |
| L1361 | Phosphatidylserine synthase | 2133 |
| L1362 | Phosphoglycolate phosphatase | 2134 |
| L1363 | Phosphoglycolate phosphatase | 2135 |
| L1364 | Phosphoglycolate phosphatase | 2136 |
| L1365 | Phosphoglycolate phosphatase | 2137 |
| L1366 | Phospholipase D | 2138 |
| L1367 | Phospholipase D | 2139 |
| L1368 | Phospholipase D | 2140 |
| L1369 | Phosphoribosylamine--glycine ligase | 2141 |
| L1370 | Phosphoribosylamine--glycine ligase | 2142 |
| L1371 | Phosphotransferase system, enzyme I | 2143 |
| L1372 | Photosystem II d1 protease | 2144 |
| L1373 | Photosystem II d1 protease | 2145 |
| L1374 | Photosystem II d1 protease | 2146 |
| L1375 | Photosystem II d1 protease | 2147 |
| L1376 | Photosystem II d1 protease | 2148 |
| L1377 | Phthalate dioxygenase reductase | 2149 |
| L1378 | P-hydroxybenzoate hydroxylase | DGL |
| L1379 | P-hydroxybenzoate hydroxylase | IDL |
| L1380 | P-hydroxybenzoate hydroxylase | RLK |
| L1381 | P-hydroxybenzoate hydroxylase | 2150 |
| L1382 | P-hydroxybenzoate hydroxylase | 2151 |

TABLE 2-continued

| Linkers | | |
|---|---|---|
| Linker No. | Description | SEQ ID NO or SEQUENCE |
| L1383 | P-hydroxybenzoate hydroxylase | 2152 |
| L1384 | P-hydroxybenzoate hydroxylase | 2153 |
| L1385 | P-hydroxybenzoate hydroxylase | 2154 |
| L1386 | P-hydroxybenzoate hydroxylase | 2155 |
| L1387 | P-hydroxybenzoate hydroxylase | 2156 |
| L1388 | P-hydroxybenzoate hydroxylase | 2157 |
| L1389 | P-hydroxybenzoate hydroxylase | 2158 |
| L1390 | P-hydroxybenzoate hydroxylase | 2159 |
| L1391 | P-hydroxybenzoate hydroxylase | 2160 |
| L1392 | P-hydroxybenzoate hydroxylase | 2161 |
| L1393 | P-hydroxybenzoate hydroxylase | 2162 |
| L1394 | P-hydroxybenzoate hydroxylase | 2163 |
| L1395 | P-hydroxybenzoate hydroxylase | 2164 |
| L1396 | P-hydroxybenzoate hydroxylase | 2165 |
| L1397 | P-hydroxybenzoate hydroxylase | 2166 |
| L1398 | Phytase | LNF |
| L1399 | Phytase | QSN |
| L1400 | Phytase | 2167 |
| L1401 | Phytase | 2168 |
| L1402 | Phytase | 2169 |
| L1403 | Phytase | 2170 |
| L1404 | Phytase | 2171 |
| L1405 | Phytase | 2172 |
| L1406 | Phytase | 2173 |
| L1407 | Phytase | 2174 |
| L1408 | Pirin | LKS |
| L1409 | Pirin | SGE |
| L1410 | Pirin | 2175 |
| L1411 | Pirin | 2176 |
| L1412 | Pirin | 2177 |
| L1413 | Pirin | 2178 |
| L1414 | Pirin | 2179 |
| L1415 | Pirin | 2180 |
| L1416 | Poly(A) polymerase | 2181 |
| L1417 | Poly(A) polymerase | 2182 |
| L1418 | Poly(A) polymerase | 2183 |
| L1419 | Poly(A) polymerase | 2184 |
| L1420 | Poly(A) polymerase | 2185 |
| L1421 | Poly(A) polymerase | 2186 |
| L1422 | Poly(A) polymerase | 2187 |
| L1423 | Poly(A) polymerase | 2188 |
| L1424 | Poly(A) polymerase | 2189 |
| L1425 | Poly(A) polymerase | 2190 |
| L1426 | Poly(A) polymerase | 2191 |
| L1427 | Poly(A) polymerase | 2192 |
| L1428 | Poly(rC)-binding protein 2 | 2193 |
| L1429 | Polymerase x | 2194 |
| L1430 | Polymerase x | 2195 |
| L1431 | Polypeptide N-acetylgalactosaminyltransferase 2 | 2196 |
| L1432 | Polypeptide N-acetylgalactosaminyltransferase 2 | 2197 |
| L1433 | Polyphosphate kinase | 2198 |
| L1434 | Polyphosphate kinase | 2199 |
| L1435 | Polyphosphate kinase | 2200 |
| L1436 | Polypyrimidine tract-binding protein | 2201 |
| L1437 | Porcine pancreatic spasmolytic polypeptide | 2202 |
| L1438 | Possible 3-mercaptopyruvate sulfurtransferase | LFR |
| L1439 | Possible 3-mercaptopyruvate sulfurtransferase | YGM |
| L1440 | Possible 3-mercaptopyruvate sulfurtransferase | 2203 |
| L1441 | Possible 3-mercaptopyruvate sulfurtransferase | 2204 |
| L1442 | Possible 3-mercaptopyruvate sulfurtransferase | 2205 |
| L1443 | Postsynaptic density protein 95 | 2206 |
| L1444 | Postsynaptic density protein 95 | 2207 |
| L1445 | Predicted sugar phosphatases of the HAD superfamily | IAI |
| L1446 | Predicted sugar phosphatases of the HAD superfamily | 2208 |
| L1447 | Predicted sugar phosphatases of the HAD superfamily | 2209 |
| L1448 | Predicted sugar phosphatases of the HAD superfamily | 2210 |
| L1449 | Predicted sugar phosphatases of the HAD superfamily | 2211 |
| L1450 | Predicted sugar phosphatases of the HAD superfamily | 2212 |
| L1451 | Predicted sugar phosphatases of the HAD superfamily | 2213 |
| L1452 | Predicted sugar phosphatases of the HAD superfamily | 2214 |
| L1453 | Predicted sugar phosphatases of the HAD superfamily | 2215 |
| L1454 | Preprotein translocase SecA | ITF |
| L1455 | Preprotein translocase SecA | LID |
| L1456 | Preprotein translocase SecA | 2216 |
| L1457 | Preprotein translocase SecA | 2217 |

TABLE 2-continued

Linkers

| Linker No. | Description | SEQ ID NO or SEQUENCE |
|---|---|---|
| L1458 | Preprotein translocase SecA | 2218 |
| L1459 | Preprotein translocase SecA | 2219 |
| L1460 | Preprotein translocase SecA | 2220 |
| L1461 | Preprotein translocase SecA | 2221 |
| L1462 | Preprotein translocase SecA | 2222 |
| L1463 | Preprotein translocase SecA | 2223 |
| L1464 | Preprotein translocase SecA | 2224 |
| L1465 | Preprotein translocase SecA | 2225 |
| L1466 | Preprotein translocase SecA | 2226 |
| L1467 | Preprotein translocase SecA | 2227 |
| L1468 | Preprotein translocase SecA | 2228 |
| L1469 | Preprotein translocase SecA | 2229 |
| L1470 | Preprotein translocase SecA | 2230 |
| L1471 | Preprotein translocase SecA | 2231 |
| L1472 | Preprotein translocase SecA | 2232 |
| L1473 | PrfA | ING |
| L1474 | Probable 16s rRNA-processing protein RimM | 2233 |
| L1475 | Probable biphenyl-2,3-diol 1,2-dioxygenase BphC | 2234 |
| L1476 | Probable chorismate mutase | LLA |
| L1477 | Probable chorismate mutase | 2235 |
| L1478 | Probable chorismate mutase | 2236 |
| L1479 | Probable ferredoxin-dependent nitrite reductase NirA | VPL |
| L1480 | Probable ferredoxin-dependent nitrite reductase NirA | WGI |
| L1481 | Probable ferredoxin-dependent nitrite reductase NirA | 2237 |
| L1482 | Probable ferredoxin-dependent nitrite reductase NirA | 2238 |
| L1483 | Probable ferredoxin-dependent nitrite reductase NirA | 2239 |
| L1484 | Probable ferredoxin-dependent nitrite reductase NirA | 2240 |
| L1485 | Probable ferredoxin-dependent nitrite reductase NirA | 2241 |
| L1486 | Probable ferredoxin-dependent nitrite reductase NirA | 2242 |
| L1487 | Probable ferredoxin-dependent nitrite reductase NirA | 2243 |
| L1488 | Probable ferredoxin-dependent nitrite reductase NirA | 2244 |
| L1489 | Probable ferredoxin-dependent nitrite reductase NirA | 2245 |
| L1490 | Probable ferredoxin-dependent nitrite reductase NirA | 2246 |
| L1491 | Probable ferredoxin-dependent nitrite reductase NirA | 2247 |
| L1492 | Probable ferredoxin-dependent nitrite reductase NirA | 2248 |
| L1493 | Probable galactokinase | 2249 |
| L1494 | Probable galactokinase | 2250 |
| L1495 | Probable galactokinase | 2251 |
| L1496 | Probable galactokinase | 2252 |
| L1497 | Probable galactokinase | 2253 |
| L1498 | Probable galactokinase | 2254 |
| L1499 | Probable galactokinase | 2255 |
| L1500 | Probable galactokinase | 2256 |
| L1501 | Probable galactokinase | 2257 |
| L1502 | Probable galactokinase | 2258 |
| L1503 | Probable galactokinase | 2259 |
| L1504 | Probable galactokinase | 2260 |
| L1505 | Probable glutathione S-transferase | 2261 |
| L1506 | Probable GST-related protein | 2262 |
| L1507 | Probable HPr(Ser) kinase/phosphatase | 2263 |
| L1508 | Probable thiosulfate sulfur transferase | 2264 |
| L1509 | Probable thiosulfate sulfur transferase | 2265 |
| L1510 | Probable thiosulfate sulfur transferase | 2266 |
| L1511 | Probable thiosulfate sulfur transferase | 2267 |
| L1512 | Probable thiosulfate sulfur transferase | 2268 |
| L1513 | Probable thiosulfate sulfur transferase | 2269 |
| L1514 | Probable thiosulfate sulfur transferase | 2270 |
| L1515 | Probable thiosulfate sulfur transferase | 2271 |
| L1516 | Probable tRNA pseudouridine synthase D | 2272 |
| L1517 | Probable tRNA pseudouridine synthase D | 2273 |
| L1518 | Probable tRNA pseudouridine synthase D | 2274 |
| L1519 | Probable tRNA pseudouridine synthase D | 2275 |
| L1520 | Probable tRNA pseudouridine synthase D | 2276 |
| L1521 | Probable tRNA pseudouridine synthase D | 2277 |
| L1522 | Programed cell death protein 8 | SKE |
| L1523 | Programed cell death protein 8 | TLQ |
| L1524 | Programed cell death protein 8 | 2278 |
| L1525 | Programed cell death protein 8 | 2279 |
| L1526 | Programed cell death protein 8 | 2280 |
| L1527 | Programed cell death protein 8 | 2281 |
| L1528 | Programed cell death protein 8 | 2282 |
| L1529 | Programed cell death protein 8 | 2283 |
| L1530 | Programed cell death protein 8 | 2284 |
| L1531 | Programed cell death protein 8 | 2285 |
| L1532 | Programed cell death protein 8 | 2286 |

TABLE 2-continued

Linkers

| Linker No. | Description | SEQ ID NO or SEQUENCE |
|---|---|---|
| L1533 | Programed cell death protein 8 | 2287 |
| L1534 | Programed cell death protein 8 | 2288 |
| L1535 | Programed cell death protein 8 | 2289 |
| L1536 | Programed cell death protein 8 | 2290 |
| L1537 | Programed cell death protein 8 | 2291 |
| L1538 | Programed cell death protein 8 | 2292 |
| L1539 | Programed cell death protein 8 | 2293 |
| L1540 | Programed cell death protein 8 | 2294 |
| L1541 | Programed cell death protein 8 | 2295 |
| L1542 | Proline oxidase | 2296 |
| L1543 | Prolyl-tRNA synthetase | 2297 |
| L1544 | Prostaglandin G/H synthase 1 | PEI |
| L1545 | Prostaglandin G/H synthase 1 | 2298 |
| L1546 | Protease | 2299 |
| L1547 | Protease | 2300 |
| L1548 | Protease | 2301 |
| L1549 | Protease DegS | 2302 |
| L1550 | Protease DegS | 2303 |
| L1551 | Protease DegS | 2304 |
| L1552 | Protease DegS | 2305 |
| L1553 | Protease III | NAR |
| L1554 | Protease III | RNP |
| L1555 | Protease III | 2306 |
| L1556 | Protease III | 2307 |
| L1557 | Protease III | 2308 |
| L1558 | Protease III | 2309 |
| L1559 | Protease III | 2310 |
| L1560 | Protease III | 2311 |
| L1561 | Protease III | 2312 |
| L1562 | Protease III | 2313 |
| L1563 | Protease III | 2314 |
| L1564 | Protease III | 2315 |
| L1565 | Protease III | 2316 |
| L1566 | Protease III | 2317 |
| L1567 | Protease III | 2318 |
| L1568 | Protease III | 2319 |
| L1569 | Protease III | 2320 |
| L1570 | Protease III | 2321 |
| L1571 | Protease III | 2322 |
| L1572 | Protease III | 2323 |
| L1573 | Protease III | 2324 |
| L1574 | Protease III | 2325 |
| L1575 | Protection of telomeres 1 | 2326 |
| L1576 | Protection of telomeres 1 | 2327 |
| L1577 | Protein (CD58) | 2328 |
| L1578 | Protein (CRP1) | 2329 |
| L1579 | Protein (DNA polymerase) | 2330 |
| L1580 | Protein (DNA polymerase) | 2331 |
| L1581 | Protein (DNA polymerase) | 2332 |
| L1582 | Protein (electron transfer flavoprotein) | 2333 |
| L1583 | Protein (electron transfer flavoprotein) | 2334 |
| L1584 | Protein (Ffh) | 2335 |
| L1585 | Protein (Ffh) | 2336 |
| L1586 | Protein (Ffh) | 2337 |
| L1587 | Protein (Ffh) | 2338 |
| L1588 | Protein (Ffh) | 2339 |
| L1589 | Protein (FokI restriction endonuclease) | 2340 |
| L1590 | Protein (FokI restriction endonuclease) | 2341 |
| L1591 | Protein (FokI restriction endonuclease) | 2342 |
| L1592 | Protein (FokI restriction endonuclease) | 2343 |
| L1593 | Protein (FokI restriction endonuclease) | 2344 |
| L1594 | Protein (FokI restriction endonuclease) | 2345 |
| L1595 | Protein (FokI restriction endonuclease) | 2346 |
| L1596 | Protein (FokI restriction endonuclease) | 2347 |
| L1597 | Protein (FokI restriction endonuclease) | 2348 |
| L1598 | Protein (neural cell adhesion molecule) | 2349 |
| L1599 | Protein (neural cell adhesion molecule) | 2350 |
| L1600 | Protein (neural cell adhesion molecule) | 2351 |
| L1601 | Protein (nine-haem cytochrome c) | FTH |
| L1602 | Protein (nine-haem cytochrome c) | 2352 |
| L1603 | Protein (nine-haem cytochrome c) | 2353 |
| L1604 | Protein (nine-haem cytochrome c) | 2354 |
| L1605 | Protein (nine-haem cytochrome c) | 2355 |
| L1606 | Protein (nine-haem cytochrome c) | 2356 |
| L1607 | Protein (nine-haem cytochrome c) | 2357 |

TABLE 2-continued

Linkers

| Linker No. | Description | SEQ ID NO or SEQUENCE |
|---|---|---|
| L1608 | Protein (nine-haem cytochrome c) | 2358 |
| L1609 | Protein (nine-haem cytochrome c) | 2359 |
| L1610 | Protein (protease/helicase NS3) | 2360 |
| L1611 | Protein (protease/helicase NS3) | 2361 |
| L1612 | Protein (protease/helicase NS3) | 2362 |
| L1613 | Protein (protease/helicase NS3) | 2363 |
| L1614 | Protein disulfide oxidoreductase | 2364 |
| L1615 | Protein disulfide oxidoreductase | 2365 |
| L1616 | Protein disulfide-isomerase A4 | 2366 |
| L1617 | Protein kinase PKR | 2367 |
| L1618 | Protein kinase PKR | 2368 |
| L1619 | Protein TolB | VNK |
| L1620 | Protein TolB | 2369 |
| L1621 | Protein TolB | 2370 |
| L1622 | Protein TolB | 2371 |
| L1623 | Protein TolB | 2372 |
| L1624 | Protein TolB | 2373 |
| L1625 | Protein TolB | 2374 |
| L1626 | Protein translation elongation factor 1A | 2375 |
| L1627 | Protein transport protein Sec24 | DRN |
| L1628 | Protein transport protein Sec24 | 2376 |
| L1629 | Protein transport protein Sec24 | 2377 |
| L1630 | Protein transport protein Sec24 | 2378 |
| L1631 | Protein transport protein Sec24 | 2379 |
| L1632 | Protein transport protein Sec24 | 2380 |
| L1633 | Protein transport protein Sec24 | 2381 |
| L1634 | Protein transport protein Sec24 | 2382 |
| L1635 | Protein transport protein Sec24 | 2383 |
| L1636 | Pseudouridine synthase CBF5 | AIQ |
| L1637 | Pseudouridine synthase CBF5 | 2384 |
| L1638 | Pseudouridine synthase CBF5 | 2385 |
| L1639 | Putative acetylglutamate synthase | 2386 |
| L1640 | Putative acetylglutamate synthase | 2387 |
| L1641 | Putative acetylglutamate synthase | 2388 |
| L1642 | Putative family 31 glucosidase YicI | 2389 |
| L1643 | Putative family 31 glucosidase YicI | 2390 |
| L1644 | Putative family 31 glucosidase YicI | 2391 |
| L1645 | Putative glutathione transferase | 2392 |
| L1646 | Putative glutathione transferase | 2393 |
| L1647 | Putative glutathione transferase | 2394 |
| L1648 | Putative GNTR-family transcriptional regulator | 2395 |
| L1649 | Putative GNTR-family transcriptional regulator | 2396 |
| L1650 | Putative GNTR-family transcriptional regulator | 2397 |
| L1651 | Putative HTH-type transcriptional regulator PH0061 | 2398 |
| L1652 | Putative HTH-type transcriptional regulator PH1519 | 2399 |
| L1653 | Putative HTH-type transcriptional regulator PH1519 | 2400 |
| L1654 | Putative metallopeptidase | 2401 |
| L1655 | Putative N-acetylmannosamine kinase | 2402 |
| L1656 | Putative N-acetylmannosamine kinase | 2403 |
| L1657 | Putative N-acetylmannosamine kinase | 2404 |
| L1658 | Putative NADP oxidoreductase BF3122 | 2405 |
| L1659 | Putative NADP oxidoreductase BF3122 | 2406 |
| L1660 | Putative NADP oxidoreductase BF3122 | 2407 |
| L1661 | Putative NADP oxidoreductase BF3122 | 2408 |
| L1662 | Putative oxidoreductase | 2409 |
| L1663 | Putative secreted alpha-galactosidase | PLP |
| L1664 | Putative secreted alpha-galactosidase | TNG |
| L1665 | Putative secreted alpha-galactosidase | 2410 |
| L1666 | Putative secreted alpha-galactosidase | 2411 |
| L1667 | Putative secreted alpha-galactosidase | 2412 |
| L1668 | Putative tagatose-6-phosphate ketose/aldose isomerase | DKA |
| L1669 | Putative tagatose-6-phosphate ketose/aldose isomerase | 2413 |
| L1670 | Putative tagatose-6-phosphate ketose/aldose isomerase | 2414 |
| L1671 | Putative tagatose-6-phosphate ketose/aldose isomerase | 2415 |
| L1672 | Putative transcriptional regulator GntR | 2416 |
| L1673 | Putative transcriptional repressor (TetR/AcrR family) | KFR |
| L1674 | Putative transcriptional repressor (TetR/AcrR family) | 2417 |
| L1675 | Putative uncharacterized protein | 2418 |
| L1676 | Putative uncharacterized protein | 2419 |
| L1677 | Putative uncharacterized protein | 2420 |
| L1678 | Putative uncharacterized protein | 2421 |
| L1679 | Putative uncharacterized protein | 2422 |
| L1680 | Putative uncharacterized protein | 2423 |
| L1681 | Putative uncharacterized protein | 2424 |
| L1682 | Putative uncharacterized protein | 2425 |

TABLE 2-continued

Linkers

| Linker No. | Description | SEQ ID NO or SEQUENCE |
|---|---|---|
| L1683 | Putative uncharacterized protein | 2426 |
| L1684 | Pyruvate decarboxylase | CAA |
| L1685 | Pyruvate decarboxylase | 2427 |
| L1686 | Pyruvate decarboxylase | 2428 |
| L1687 | Pyruvate decarboxylase | 2429 |
| L1688 | Pyruvate decarboxylase | 2430 |
| L1689 | Pyruvate decarboxylase | 2431 |
| L1690 | Pyruvate dehydrogenase [lipoamide] kinase isozyme 2, mitochondrial | YVP |
| L1691 | Pyruvate dehydrogenase [lipoamide] kinase isozyme 2, mitochondrial | 2432 |
| L1692 | Pyruvate dehydrogenase [lipoamide] kinase isozyme 2, mitochondrial | 2433 |
| L1693 | Pyruvate dehydrogenase E1 component subunit beta, mitochondrial | 2434 |
| L1694 | Pyruvate dehydrogenase E1 component subunit beta, mitochondrial | 2435 |
| L1695 | Pyruvate dehydrogenase E1 component subunit beta, mitochondrial | 2436 |
| L1696 | Pyruvate phosphate dikinase | FNP |
| L1697 | Pyruvate phosphate dikinase | SAL |
| L1698 | Pyruvate phosphate dikinase | 2437 |
| L1699 | Pyruvate phosphate dikinase | 2438 |
| L1700 | Pyruvate phosphate dikinase | 2439 |
| L1701 | Pyruvate phosphate dikinase | 2440 |
| L1702 | Pyruvate phosphate dikinase | 2441 |
| L1703 | Pyruvate phosphate dikinase | 2442 |
| L1704 | Pyruvate phosphate dikinase | 2443 |
| L1705 | Pyruvate phosphate dikinase | 2444 |
| L1706 | Pyruvate phosphate dikinase | 2445 |
| L1707 | Pyruvate phosphate dikinase | 2446 |
| L1708 | Pyruvate-ferredoxin oxidoreductase | VRL |
| L1709 | Pyruvate-ferredoxin oxidoreductase | 2447 |
| L1710 | Pyruvate-ferredoxin oxidoreductase | 2448 |
| L1711 | Pyruvate-ferredoxin oxidoreductase | 2449 |
| L1712 | Pyruvate-ferredoxin oxidoreductase | 2450 |
| L1713 | Pyruvate-ferredoxin oxidoreductase | 2451 |
| L1714 | Pyruvate-ferredoxin oxidoreductase | 2452 |
| L1715 | Pyruvate-ferredoxin oxidoreductase | 2453 |
| L1716 | Pyruvate-ferredoxin oxidoreductase | 2454 |
| L1717 | Pyruvate-ferredoxin oxidoreductase | 2455 |
| L1718 | Pyruvate-ferredoxin oxidoreductase | 2456 |
| L1719 | Pyruvate-ferredoxin oxidoreductase | 2457 |
| L1720 | Pyruvate-ferredoxin oxidoreductase | 2458 |
| L1721 | Pyruvate-ferredoxin oxidoreductase | 2459 |
| L1722 | Pyruvate-ferredoxin oxidoreductase | 2460 |
| L1723 | Pyruvate-ferredoxin oxidoreductase | 2461 |
| L1724 | Pyruvate-ferredoxin oxidoreductase | 2462 |
| L1725 | Pyruvate-ferredoxin oxidoreductase | 2463 |
| L1726 | Pyruvate-ferredoxin oxidoreductase | 2464 |
| L1727 | Pyruvate-ferredoxin oxidoreductase | 2465 |
| L1728 | Quinohemoprotein amine dehydrogenase 60 kDa subunit | 2466 |
| L1729 | Quinohemoprotein amine dehydrogenase 60 kDa subunit | 2467 |
| L1730 | Quinohemoprotein amine dehydrogenase 60 kDa subunit | 2468 |
| L1731 | Quinohemoprotein amine dehydrogenase 60 kDa subunit | 2469 |
| L1732 | Quinohemoprotein amine dehydrogenase 60 kDa subunit | 2470 |
| L1733 | Quinohemoprotein amine dehydrogenase 60 kDa subunit | 2471 |
| L1734 | Quinohemoprotein amine dehydrogenase 60 kDa subunit | 2472 |
| L1735 | Quinohemoprotein amine dehydrogenase 60 kDa subunit | 2473 |
| L1736 | Quinohemoprotein amine dehydrogenase 60 kDa subunit | 2474 |
| L1737 | Quinohemoprotein amine dehydrogenase 60 kDa subunit | 2475 |
| L1738 | Rag1 | 2476 |
| L1739 | Rag1 | 2477 |
| L1740 | Receptor-type tyrosine-protein phosphatase Mu | 2478 |
| L1741 | Receptor-type tyrosine-protein phosphatase Mu | 2479 |
| L1742 | RecG | 2480 |
| L1743 | RecG | 2481 |
| L1744 | RecG | 2482 |
| L1745 | RecG | 2483 |
| L1746 | RecG | 2484 |
| L1747 | RecG | 2485 |
| L1748 | RecG | 2486 |
| L1749 | RecG | 2487 |
| L1750 | RecG | 2488 |
| L1751 | RecG | 2489 |
| L1752 | RecG | 2490 |
| L1753 | RecG | 2491 |
| L1754 | Recombination endonuclease VII | 2492 |
| L1755 | Recombining binding protein suppressor of hairless | 2493 |
| L1756 | Restriction endonuclease | ERV |
| L1757 | Restriction endonuclease | 2494 |

TABLE 2-continued

Linkers

| Linker No. | Description | SEQ ID NO or SEQUENCE |
|---|---|---|
| L1758 | Restriction endonuclease | 2495 |
| L1759 | Restriction endonuclease | 2496 |
| L1760 | Retinaldehyde-binding protein 1 | QYP |
| L1761 | Retinaldehyde-binding protein 1 | 2497 |
| L1762 | Retinaldehyde-binding protein 1 | 2498 |
| L1763 | Retinoblastoma pocket | 2499 |
| L1764 | RfcS | ITD |
| L1765 | RfcS | LTE |
| L1766 | RfcS | 2500 |
| L1767 | RfcS | 2501 |
| L1768 | RfcS | 2502 |
| L1769 | RfcS | 2503 |
| L1770 | RfcS | 2504 |
| L1771 | Rhamnogalacturonase B | 2505 |
| L1772 | Rhamnogalacturonase B | 2506 |
| L1773 | Rhamnogalacturonase B | 2507 |
| L1774 | Rhamnogalacturonase B | 2508 |
| L1775 | Rhamnogalacturonase B | 2509 |
| L1776 | Rhodniin | 2510 |
| L1777 | Rhodniin | 2511 |
| L1778 | Riboflavin synthase | 2512 |
| L1779 | Ribonuclease D | 2513 |
| L1780 | Ribonuclease D | 2514 |
| L1781 | Ribonuclease D | 2515 |
| L1782 | Ribonuclease TTHA0252 | 2516 |
| L1783 | Ribonuclease TTHA0252 | 2517 |
| L1784 | Ribonuclease TTHA0252 | 2518 |
| L1785 | Ribonuclease TTHA0252 | 2519 |
| L1786 | Ribonuclease TTHA0252 | 2520 |
| L1787 | Ribonuclease TTHA0252 | 2521 |
| L1788 | Ribonucleotide reductase r1 protein | 2522 |
| L1789 | Ribonucleotide reductase r1 protein | 2523 |
| L1790 | Ribonucleotide reductase r1 protein | 2524 |
| L1791 | Ribonucleotide reductase r1 protein | 2525 |
| L1792 | Ribonucleotide reductase r1 protein | 2526 |
| L1793 | Ribonucleotide reductase r1 protein | 2527 |
| L1794 | Ribosome maturation factor RimM | 2528 |
| L1795 | Ribulose-1,5 bisphosphate carboxylase/oxygenase large subunit N-methyltransferase | RHA |
| L1796 | Ribulose-1,5 bisphosphate carboxylase/oxygenase large subunit N-methyltransferase | 2529 |
| L1797 | Rigid extended P-rich | 2530 |
| L1798 | Rigid extended P-rich | 2531 |
| L1799 | Rigid extended P-rich | 2532 |
| L1800 | Rigid extended P-rich | 2533 |
| L1801 | Rigid extended P-rich | 2534 |
| L1802 | Rigid extended P-rich | 2535 |
| L1803 | Rigid extended P-rich | 2536 |
| L1804 | Rigid extended P-rich | 2537 |
| L1805 | Rigid extended P-rich | 2538 |
| L1806 | Rigid extended P-rich | 2539 |
| L1807 | Rigid extended P-rich | 2540 |
| L1808 | Rigid extended P-rich | 2541 |
| L1809 | Rigid extended P-rich | 2542 |
| L1810 | Rigid extended P-rich | 2543 |
| L1811 | Rigid extended P-rich | 2544 |
| L1812 | Rigid helical | 2545 |
| L1813 | Rigid helical | 2546 |
| L1814 | Rigid helical | 2547 |
| L1815 | Rigid helical | 2548 |
| L1816 | Rigid helical | 2549 |
| L1817 | Rigid helical | 2550 |
| L1818 | Rigid helical | 2551 |
| L1819 | Rigid helical | 2552 |
| L1820 | RNA binding domain of rho transcription termination factor | 2553 |
| L1821 | RNA binding protein ZFa | 2554 |
| L1822 | Rob transcription factor | 2555 |
| L1823 | Rob transcription factor | 2556 |
| L1824 | RP2 lipase | 2557 |
| L1825 | Rubrerythrin | 2558 |
| L1826 | S-adenosylmethionine synthetase | 2559 |
| L1827 | Sarcoplasmic/endoplasmic reticulum calcium ATPase 1 | QFD |
| L1828 | Sarcoplasmic/endoplasmic reticulum calcium ATPase 1 | 2560 |
| L1829 | Sarcoplasmic/endoplasmic reticulum calcium ATPase 1 | 2561 |
| L1830 | Sarcoplasmic/endoplasmic reticulum calcium ATPase 1 | 2562 |
| L1831 | Sarcoplasmic/endoplasmic reticulum calcium ATPase 1 | 2563 |
| L1832 | Sarcoplasmic/endoplasmic reticulum calcium ATPase 1 | 2564 |

TABLE 2-continued

Linkers

| Linker No. | Description | SEQ ID NO or SEQUENCE |
|---|---|---|
| L1833 | Sarcoplasmic/endoplasmic reticulum calcium ATPase 1 | 2565 |
| L1834 | Sarcoplasmic/endoplasmic reticulum calcium ATPase 1 | 2566 |
| L1835 | Sarcoplasmic/endoplasmic reticulum calcium ATPase 1 | 2567 |
| L1836 | Sarcoplasmic/endoplasmic reticulum calcium ATPase 1 | 2568 |
| L1837 | Sarcoplasmic/endoplasmic reticulum calcium ATPase 1 | 2569 |
| L1838 | Sarcoplasmic/endoplasmic reticulum calcium ATPase 1 | 2570 |
| L1839 | Sarcoplasmic/endoplasmic reticulum calcium ATPase 1 | 2571 |
| L1840 | Sarcoplasmic/endoplasmic reticulum calcium ATPase 1 | 2572 |
| L1841 | Sarcoplasmic/endoplasmic reticulum calcium ATPase 1 | 2573 |
| L1842 | Sarcoplasmic/endoplasmic reticulum calcium ATPase 1 | 2574 |
| L1843 | Sarcoplasmic/endoplasmic reticulum calcium ATPase 1 | 2575 |
| L1844 | Sarcoplasmic/endoplasmic reticulum calcium ATPase 1 | 2576 |
| L1845 | Sarcoplasmic/endoplasmic reticulum calcium ATPase 1 | 2577 |
| L1846 | Sarcoplasmic/endoplasmic reticulum calcium ATPase 1 | 2578 |
| L1847 | Sarcoplasmic/endoplasmic reticulum calcium ATPase 1 | 2579 |
| L1848 | Sarcoplasmic/endoplasmic reticulum calcium ATPase 1 | 2580 |
| L1849 | Sarcoplasmic/endoplasmic reticulum calcium ATPase 1 | 2581 |
| L1850 | Sarcoplasmic/endoplasmic reticulum calcium ATPase 1 | 2582 |
| L1851 | Sarcoplasmic/endoplasmic reticulum calcium ATPase 1 | 2583 |
| L1852 | Sarcoplasmic/endoplasmic reticulum calcium ATPase 1 | 2584 |
| L1853 | Scavenger mRNA-decapping enzyme DcpS | ETG |
| L1854 | Scavenger mRNA-decapping enzyme DcpS | NIT |
| L1855 | Scavenger mRNA-decapping enzyme DcpS | 2585 |
| L1856 | Scavenger mRNA-decapping enzyme DcpS | 2586 |
| L1857 | Sec18p (residues 22-210) | 2587 |
| L1858 | Sec18p (residues 22-210) | 2588 |
| L1859 | Sensor protein | 2589 |
| L1860 | Sensor protein | 2590 |
| L1861 | Septum site-determining protein MinC | 2591 |
| L1862 | Serine acetyltransferase | 2592 |
| L1863 | Serine protease/NTPase/helicase NS3 | 2593 |
| L1864 | Serine protease/NTPase/helicase NS3 | 2594 |
| L1865 | Serine protease/NTPase/helicase NS3 | 2595 |
| L1866 | Serine rich linker | 2596 |
| L1867 | Serine rich linker | 2597 |
| L1868 | Serine rich linker | 2598 |
| L1869 | Serine rich linker | 2599 |
| L1870 | Serine rich linker | 2600 |
| L1871 | Serine rich linker | 2601 |
| L1872 | Serine rich linker | 2602 |
| L1873 | Seryl-tRNA synthetase | 2603 |
| L1874 | Sialidase | 2604 |
| L1875 | Sialidase B | SLT |
| L1876 | Sialidase B | VRE |
| L1877 | Sialidase B | 2605 |
| L1878 | Sialidase B | 2606 |
| L1879 | Sialidase B | 2607 |
| L1880 | Sialidase B | 2608 |
| L1881 | Sialidase B | 2609 |
| L1882 | Sialidase B | 2610 |
| L1883 | SIgnal peptIdase I | SRR |
| L1884 | SIgnal peptIdase I | 2611 |
| L1885 | SIgnal peptIdase I | 2612 |
| L1886 | SIgnal peptIdase I | 2613 |
| L1887 | SIgnal peptIdase I | 2614 |
| L1888 | SIgnal peptIdase I | 2615 |
| L1889 | SIgnal peptIdase I | 2616 |
| L1890 | SIgnal peptIdase I | 2617 |
| L1891 | SIgnal peptIdase I | 2618 |
| L1892 | SIgnal peptIdase I | 2619 |
| L1893 | SIgnal peptIdase I | 2620 |
| L1894 | Signal recognition particle protein | 2621 |
| L1895 | Signal transducer and activator of transcription1-alpha/beta | NDE |
| L1896 | Signal transducer and activator of transcription1-alpha/beta | SSF |
| L1897 | Signal transducer and activator of transcription1-alpha/beta | 2622 |
| L1898 | Signal transducer and activator of transcription1-alpha/beta | 2623 |
| L1899 | Signal transducer and activator of transcription1-alpha/beta | 2624 |
| L1900 | Signal transducer and activator of transcription1-alpha/beta | 2625 |
| L1901 | Signal transduction protein CBL | 2626 |
| L1902 | Signal transduction protein CBL | 2627 |
| L1903 | Similar to RAD54-like | AKP |
| L1904 | Similar to RAD54-like | EYF |
| L1905 | Similar to RAD54-like | RFE |
| L1906 | Similar to RAD54-like | 2628 |
| L1907 | Similar to RAD54-like | 2629 |

TABLE 2-continued

| Linkers | | |
|---|---|---|
| Linker No. | Description | SEQ ID NO or SEQUENCE |
| L1908 | Similar to RAD54-like | 2630 |
| L1909 | Similar to RAD54-like | 2631 |
| L1910 | Similar to RAD54-like | 2632 |
| L1911 | Similar to RAD54-like | 2633 |
| L1912 | Similar to RAD54-like | 2634 |
| L1913 | Similar to RAD54-like | 2635 |
| L1914 | Similar to RAD54-like | 2636 |
| L1915 | Similar to RAD54-like | 2637 |
| L1916 | SKD1 protein | LMQ |
| L1917 | SKD1 protein | 2638 |
| L1918 | SKD1 protein | 2639 |
| L1919 | SKD1 protein | 2640 |
| L1920 | SKD1 protein | 2641 |
| L1921 | SKD1 protein | 2642 |
| L1922 | Sll1358 protein | 2643 |
| L1923 | Sll1358 protein | 2644 |
| L1924 | Sll1358 protein | 2645 |
| L1925 | Sll1358 protein | 2646 |
| L1926 | Soluble IFN alpha/beta receptor | 2647 |
| L1927 | Soluble IFN alpha/beta receptor | 2648 |
| L1928 | Sporozoite-specific SAG protein | 2649 |
| L1929 | Staphylococcal accessory regulator a homologue | 2650 |
| L1930 | Staphylococcal nuclease domain-containing protein 1 | 2651 |
| L1931 | Staphylococcal nuclease domain-containing protein 1 | 2652 |
| L1932 | Staphylococcal nuclease domain-containing protein 1 | 2653 |
| L1933 | Staphylococcal nuclease domain-containing protein 1 | 2654 |
| L1934 | Staphylococcal nuclease domain-containing protein 1 | 2655 |
| L1935 | Staphylococcal nuclease domain-containing protein 1 | 2656 |
| L1936 | Stat protein | 2657 |
| L1937 | Stat protein | 2658 |
| L1938 | Stat protein | 2659 |
| L1939 | Stat protein | 2660 |
| L1940 | Stat protein | 2661 |
| L1941 | Stat protein | 2662 |
| L1942 | Stat protein | 2663 |
| L1943 | Stat protein | 2664 |
| L1944 | Stat protein | 2665 |
| L1945 | Stat protein | 2666 |
| L1946 | Stat protein | 2667 |
| L1947 | Stat protein | 2668 |
| L1948 | Stat protein | 2669 |
| L1949 | Stat protein | 2670 |
| L1950 | Stat protein | 2671 |
| L1951 | Subtilisin-like protease | 2672 |
| L1952 | Succinyl-CoA ligase [GDP-forming] alpha-chain, mitochondrial | 2673 |
| L1953 | Succinyl-CoA ligase [GDP-forming] alpha-chain, mitochondrial | 2674 |
| L1954 | Succinyl-CoA ligase [GDP-forming] alpha-chain, mitochondrial | 2675 |
| L1955 | Succinyl-CoA ligase [GDP-forming] alpha-chain, mitochondrial | 2676 |
| L1956 | Succinyl-CoA ligase [GDP-forming] alpha-chain, mitochondrial | 2677 |
| L1957 | Succinyl-CoA ligase [GDP-forming] alpha-chain, mitochondrial | 2678 |
| L1958 | Succinyl-CoA synthetase beta chain | ADG |
| L1959 | Succinyl-CoA synthetase beta chain | RQP |
| L1960 | Succinyl-CoA synthetase beta chain | 2679 |
| L1961 | Succinyl-CoA synthetase beta chain | 2680 |
| L1962 | Succinyl-CoA synthetase beta chain | 2681 |
| L1963 | Succinyl-CoA synthetase beta chain | 2682 |
| L1964 | Succinyl-CoA synthetase beta chain | 2683 |
| L1965 | Succinyl-CoA synthetase beta chain | 2684 |
| L1966 | Succinyl-CoA:3-ketoacid-coenzyme A transferase | 2685 |
| L1967 | Sulfurtransferase | 2686 |
| L1968 | Superantigen SMEZ-2 | 2687 |
| L1969 | Superoxide dismutase 1 copper chaperone | 2688 |
| L1970 | Surface layer protein | 2689 |
| L1971 | Surface layer protein | 2690 |
| L1972 | Surface layer protein | 2691 |
| L1973 | Surface layer protein | 2692 |
| L1974 | Surface layer protein | 2693 |
| L1975 | Surface layer protein | 2694 |
| L1976 | Surface layer protein | 2695 |
| L1977 | Surface layer protein | 2696 |
| L1978 | T lymphocyte activation antigen | 2697 |
| L1979 | T lymphocyte activation antigen | 2698 |
| L1980 | T-cell receptor alpha chain C region | 2699 |
| L1981 | Terminal oxygenase component of carbazole | 2700 |
| L1982 | Tetanus neurotoxin | 2701 |

TABLE 2-continued

Linkers

| Linker No. | Description | SEQ ID NO or SEQUENCE |
|---|---|---|
| L1983 | Tetracycline repressor protein class D | 2702 |
| L1984 | The GTP-binding protein Obg | 2703 |
| L1985 | The GTP-binding protein Obg | 2704 |
| L1986 | The GTP-binding protein Obg | 2705 |
| L1987 | The GTP-binding protein Obg | 2706 |
| L1988 | Thioredoxin domain-containing protein 4 | 2707 |
| L1989 | Thioredoxin domain-containing protein 4 | 2708 |
| L1990 | Thiosulfate sulfurtransferase | IDP |
| L1991 | Thiosulfate sulfurtransferase | 2709 |
| L1992 | Thiosulfate sulfurtransferase | 2710 |
| L1993 | Thiosulfate sulfurtransferase | 2711 |
| L1994 | Thiosulfate sulfurtransferase | 2712 |
| L1995 | Threonyl-tRNA synthetase | 2713 |
| L1996 | Threonyl-tRNA synthetase | 2714 |
| L1997 | Threonyl-tRNA synthetase | 2715 |
| L1998 | Threonyl-tRNA synthetase | 2716 |
| L1999 | Threonyl-tRNA synthetase | 2717 |
| L2000 | Threonyl-tRNA synthetase | 2718 |
| L2001 | Threonyl-tRNA synthetase | 2719 |
| L2002 | Threonyl-tRNA synthetase | 2720 |
| L2003 | Threonyl-tRNA synthetase | 2721 |
| L2004 | Threonyl-tRNA synthetase 1 | 2722 |
| L2005 | Threonyl-tRNA synthetase 1 | 2723 |
| L2006 | Threonyl-tRNA synthetase 1 | 2724 |
| L2007 | Threonyl-tRNA synthetase 1 | 2725 |
| L2008 | Threonyl-tRNA synthetase 1 | 2726 |
| L2009 | Threonyl-tRNA synthetase 1 | 2727 |
| L2010 | Threonyl-tRNA synthetase 1 | 2728 |
| L2011 | Threonyl-tRNA synthetase 1 | 2729 |
| L2012 | Thrombospondin 1 | 2730 |
| L2013 | Tick-borne encephalitis virus glycoprotein | 2731 |
| L2014 | Titin | 2732 |
| L2015 | Titin | 2733 |
| L2016 | TLR1789 protein | 2734 |
| L2017 | TLR1789 protein | 2735 |
| L2018 | Topoisomerase I | 2736 |
| L2019 | Topoisomerase I | 2737 |
| L2020 | Toxic shock syndrome toxin-1 | 2738 |
| L2021 | Toxic shock syndrome toxin-1 | 2739 |
| L2022 | Toxic shock syndrome toxin-1 | 2740 |
| L2023 | Toxic shock syndrome toxin-1 | 2741 |
| L2024 | T-plasminogen activator F1-G | VPV |
| L2025 | T-plasminogen activator F1-G | 2742 |
| L2026 | TpsB transporter FhaC | 2743 |
| L2027 | TpsB transporter FhaC | 2744 |
| L2028 | TpsB transporter FhaC | 2745 |
| L2029 | Transcarbamylase | 2746 |
| L2030 | Transcarbamylase | 2747 |
| L2031 | Transcription antiterminator LicT | 2748 |
| L2032 | Transcription elongation factor GreB | 2749 |
| L2033 | Transcription initiation factor IIa gamma chain | 2750 |
| L2034 | Transcription initiation factor IIb | 2751 |
| L2035 | Transcription initiation factor IIb | 2752 |
| L2036 | Transcriptional regulator (NtrC family) | 2753 |
| L2037 | Transcriptional regulator AefR | 2754 |
| L2038 | Transcriptional regulator AefR | 2755 |
| L2039 | Transcriptional regulator AefR | 2756 |
| L2040 | Transcriptional regulator AefR | 2757 |
| L2041 | Transcriptional regulator AefR | 2758 |
| L2042 | Transcriptional regulator, AsnC family | 2759 |
| L2043 | Transcriptional regulator, AsnC family | 2760 |
| L2044 | Transcriptional regulator, AsnC family | 2761 |
| L2045 | Transcriptional regulator, biotin repressor family | 2762 |
| L2046 | Transcriptional regulator, Crp/Fnr family | 2763 |
| L2047 | Transcriptional regulator, GntR family | 2764 |
| L2048 | Transcriptional regulator, HTH_3 family | 2765 |
| L2049 | Transcriptional regulator, HTH_3 family | 2766 |
| L2050 | Transcriptional regulator, HTH_3 family | 2767 |
| L2051 | Transcriptional regulator, HTH_3 family | 2768 |
| L2052 | Transcriptional regulator, HTH_3 family | 2769 |
| L2053 | Transcriptional regulator, laci family | 2770 |
| L2054 | Transcriptional regulatory protein ZraR | 2771 |
| L2055 | Transcriptional regulatory protein ZraR | 2772 |
| L2056 | Transcriptional regulatory protein ZraR | 2773 |
| L2057 | Transcriptional regulatory protein ZraR | 2774 |

TABLE 2-continued

Linkers

| Linker No. | Description | SEQ ID NO or SEQUENCE |
|---|---|---|
| L2058 | Transcriptional regulatory protein ZraR | 2775 |
| L2059 | Transcriptional regulatory protein ZraR | 2776 |
| L2060 | Transcriptional regulatory protein ZraR | 2777 |
| L2061 | Transferrin receptor protein | VSN |
| L2062 | Transferrin receptor protein | 2778 |
| L2063 | Transferrin receptor protein | 2779 |
| L2064 | Transferrin receptor protein | 2780 |
| L2065 | Transferrin receptor protein | 2781 |
| L2066 | Translation initiation factor 5A | 2782 |
| L2067 | Translation initiation factor 5A | 2783 |
| L2068 | Translation initiation factor 5A | 2784 |
| L2069 | Translation initiation factor IF2/eIF5b | 2785 |
| L2070 | Translation initiation factor IF2/eIF5b | 2786 |
| L2071 | Transposable element mariner, complete CDS | 2787 |
| L2072 | Tricorn protease | 2788 |
| L2073 | Tricorn protease | 2789 |
| L2074 | Tricorn protease | 2790 |
| L2075 | Trigger factor | 2791 |
| L2076 | Trigger factor | 2792 |
| L2077 | Trigger factor | 2793 |
| L2078 | TRNA CCA-adding enzyme | RRI |
| L2079 | TRNA CCA-adding enzyme | 2794 |
| L2080 | TRNA CCA-adding enzyme | 2795 |
| L2081 | TRNA CCA-adding enzyme | 2796 |
| L2082 | TRNA CCA-adding enzyme | 2797 |
| L2083 | TRNA nucleotidyltransferase | 2798 |
| L2084 | TRNA-splicing endonuclease | 2799 |
| L2085 | Tt1467 protein | LEA |
| L2086 | Tt1467 protein | 2800 |
| L2087 | Tumor suppressor p53-binding protein 1 | 2801 |
| L2088 | Tumor suppressor p53-binding protein 1 | 2802 |
| L2089 | Tumor suppressor p53-binding protein 1 | 2803 |
| L2090 | Tumor suppressor p53-binding protein 1 | 2804 |
| L2091 | Type A flavoprotein FprA | 2805 |
| L2092 | Type A flavoprotein FprA | 2806 |
| L2093 | Type A flavoprotein FprA | 2807 |
| L2094 | Type A flavoprotein FprA | 2808 |
| L2095 | Type A flavoprotein FprA | 2809 |
| L2096 | Type I restriction enzyme specificity protein MG438 | QMH |
| L2097 | Type I restriction enzyme specificity protein MG438 | 2810 |
| L2098 | Type I restriction enzyme specificity protein MG438 | 2811 |
| L2099 | Type I restriction-modification enzyme, S subunit | 2812 |
| L2100 | Type I restriction-modification enzyme, S subunit | 2813 |
| L2101 | Type I site-specific restriction-modification system, R (restriction) subunit | 2814 |
| L2102 | Type I site-specific restriction-modification system, R (restriction) subunit | 2815 |
| L2103 | Type I site-specific restriction-modification system, R (restriction) subunit | 2816 |
| L2104 | Type II DNA topoisomerase VI subunit B | 2817 |
| L2105 | Type II DNA topoisomerase VI subunit B | 2818 |
| L2106 | Type II DNA topoisomerase VI subunit B | 2819 |
| L2107 | Type II DNA topoisomerase VI subunit B | 2820 |
| L2108 | Type II DNA topoisomerase VI subunit B | 2821 |
| L2109 | Type II DNA topoisomerase VI subunit B | 2822 |
| L2110 | Type II DNA topoisomerase VI subunit B | 2823 |
| L2111 | Type II DNA topoisomerase VI subunit B | 2824 |
| L2112 | Type II DNA topoisomerase VI subunit B | 2825 |
| L2113 | Type II DNA topoisomerase VI subunit B | 2826 |
| L2114 | Type II DNA topoisomerase VI subunit B | 2827 |
| L2115 | Type VI secretion system component | 2828 |
| L2116 | Type VI secretion system component | 2829 |
| L2117 | Type VI secretion system component | 2830 |
| L2118 | Tyrosine-protein kinase receptor UFO | 2831 |
| L2119 | Tyrosine-protein kinase receptor UFO | 2832 |
| L2120 | Tyrosine-protein kinase ZAP-70 | 2833 |
| L2121 | Tyrosine-protein kinase ZAP-70 | 2834 |
| L2122 | Tyrosyl-DNA phosphodiesterase | 2835 |
| L2123 | Tyrosyl-DNA phosphodiesterase | 2836 |
| L2124 | Ubiquitin carboxyl-terminal hydrolase 7 | 2837 |
| L2125 | UDP-galactopyranose mutase | 2838 |
| L2126 | UDP-galactopyranose mutase | 2839 |
| L2127 | UDP-galactopyranose mutase | 2840 |
| L2128 | UDP-galactopyranose mutase | 2841 |
| L2129 | UDP-galactopyranose mutase | 2842 |
| L2130 | UDP-glucose dehydrogenase | 2843 |
| L2131 | UDP-N-acetylmuramate-L-alanine ligase | 2844 |
| L2132 | UDP-N-acetylmuramate-L-alanine ligase | 2845 |

TABLE 2-continued

Linkers

| Linker No. | Description | SEQ ID NO or SEQUENCE |
|---|---|---|
| L2133 | UDP-N-acetylmuramoylalanine--D-glutamate ligase | 2846 |
| L2134 | UDP-N-acetylmuramoylalanine--D-glntamate ligase | 2847 |
| L2135 | UDP-N-acetylmuramoylalanine-D-glutamyl-lysine-D-alanyl-D-alanine ligase, MurF protein | 2848 |
| L2136 | UDP-N-acetylmuramoylalanyl-D-glutamate--2,6-diaminopimelate ligase | 2849 |
| L2137 | UDP-N-acetylmuramoylalanyl-D-glutamate--2,6-diaminopimelate ligase | 2850 |
| L2138 | UDP-N-acetylmuramoylalanyl-D-glutamate--2,6-diaminopimelate ligase | 2851 |
| L2139 | UDP-N-acetylmuramoylalanyl-D-glutamate--2,6-diaminopimelate ligase | 2852 |
| L2140 | UDP-N-acetylmuramoylalanyl-D-glutamate--2,6-diaminopimelate ligase | 2853 |
| L2141 | UDP-N-acetylmuramoylalanyl-D-glutamate--2,6-diaminopimelate ligase | 2854 |
| L2142 | UDP-N-acetylmuramoylalanyl-D-glutamate--2,6-diaminopimelate ligase | 2855 |
| L2143 | Uncharacterized conserved protein | 2856 |
| L2144 | Uncharacterized conserved protein | 2857 |
| L2145 | Uncharacterized GST-like protein yfcF | 2858 |
| L2146 | Uncharacterized GST-like proteinprotein | 2859 |
| L2147 | Uncharacterized GST-like proteinprotein | 2860 |
| L2148 | Uncharacterized GST-like proteinprotein | 2861 |
| L2149 | Uncharacterized protein | 2862 |
| L2150 | Uncharacterized protein | 2863 |
| L2151 | Uncharacterized protein BT_1490 | 2864 |
| L2152 | Uncharacterized protein ypfI | TLR |
| L2153 | Uncharacterized protein ypfI | VHP |
| L2154 | Uncharacterized protein ypfI | 2865 |
| L2155 | Uncharacterized protein ypfI | 2866 |
| L2156 | Uncharacterized protein ypfI | 2867 |
| L2157 | Uncharacterized protein ypfI | 2868 |
| L2158 | Uncharacterized protein ypfI | 2869 |
| L2159 | Uncharacterized protein ypfI | 2870 |
| L2160 | Uncharacterized protein ypfI | 2871 |
| L2161 | Uncharacterized protein ypfI | 2872 |
| L2162 | Uncharacterized protein ypfI | 2873 |
| L2163 | Uncharacterized protein ypfI | 2874 |
| L2164 | Uncharacterized protein ypfI | 2875 |
| L2165 | Uncharacterized protein ypfI | 2876 |
| L2166 | Uncharacterized protein ypfI | 2877 |
| L2167 | Uncharacterized protein ypfI | 2878 |
| L2168 | Uncharacterized protein ypfI | 2879 |
| L2169 | Unknown protein | 2880 |
| L2170 | Unknown protein | 2881 |
| L2171 | UPF0131 protein ykqA | 2882 |
| L2172 | UPF0131 protein ykqA | 2883 |
| L2173 | UPF0131 protein ykqA | 2884 |
| L2174 | UPF0348 protein MJ0951 | 2885 |
| L2175 | UPF0348 protein MJ0951 | 2886 |
| L2176 | UPF0348 protein MJ0951 | 2887 |
| L2177 | UPF0348 protein MJ0951 | 2888 |
| L2178 | UPF0348 protein MJ0951 | 2889 |
| L2179 | UPF0348 protein MJ0951 | 2890 |
| L2180 | UPF0348 protein MJ0951 | 2891 |
| L2181 | UPF0348 protein MJ0951 | 2892 |
| L2182 | URE2 protein | 2893 |
| L2183 | Uridine diphospho-N-acetylenolpyruvylglucosaminereductase | TAK |
| L2184 | Uridine diphospho-N-acetylenolpyruvylglucosaminereductase | 2894 |
| L2185 | Uridine diphospho-N-acetylenolpyruvylglucosaminereductase | 2895 |
| L2186 | Uridine diphospho-N-acetylenolpyruvylglucosaminereductase | 2896 |
| L2187 | Uridine diphospho-N-acetylenolpyruvylglucosaminereductase | 2897 |
| L2188 | Urokinase plasminogen activator surface receptor | 2898 |
| L2189 | Urokinase plasminogen activator surface receptor | 2899 |
| L2190 | Vascular cell adhesion molecule-1 | 2900 |
| L2191 | VCP-like ATPase | 2901 |
| L2192 | VCP-like ATPase | 2902 |
| L2193 | Viral CASP8 and FADD-like apoptosis regulator | 2903 |
| L2194 | Vitamin K-dependent protein Z | 2904 |
| L2195 | VP1 protein | 2905 |
| L2196 | V-type ATP synthase alpha chain | 2906 |
| L2197 | Xaa-Pro aminopeptidase | 2907 |
| L2198 | Xaa-Pro aminopeptidase | 2908 |
| L2199 | Xaa-Pro aminopeptidase | 2909 |
| L2200 | Xaa-Pro aminopeptidase | 2910 |
| L2201 | Xanthine dehydrogenase | 2911 |
| L2202 | Xanthine dehydrogenase | 2912 |
| L2203 | Xanthine dehydrogenase | 2913 |
| L2204 | Xanthine dehydrogenase | 2914 |
| L2205 | X-prolyl dipeptidyl aminopeptidase | KSY |
| L2206 | X-prolyl dipeptidyl aminopeptidase | LDG |

TABLE 2-continued

Linkers

| Linker No. | Description | SEQ ID NO or SEQUENCE |
| --- | --- | --- |
| L2207 | X-prolyl dipeptidyl aminopeptidase | LLE |
| L2208 | X-prolyl dipeptidyl aminopeptidase | TYS |
| L2209 | X-prolyl dipeptidyl aminopeptidase | 2915 |
| L2210 | X-prolyl dipeptidyl aminopeptidase | 2916 |
| L2211 | X-prolyl dipeptidyl aminopeptidase | 2917 |
| L2212 | X-prolyl dipeptidyl aminopeptidase | 2918 |
| L2213 | X-prolyl dipeptidyl aminopeptidase | 2919 |
| L2214 | X-prolyl dipeptidyl aminopeptidase | 2920 |
| L2215 | X-prolyl dipeptidyl aminopeptidase | 2921 |
| L2216 | X-prolyl dipeptidyl aminopeptidase | 2922 |
| L2217 | X-prolyl dipeptidyl aminopeptidase | 2923 |
| L2218 | X-prolyl dipeptidyl aminopeptidase | 2924 |
| L2219 | X-prolyl dipeptidyl aminopeptidase | 2925 |
| L2220 | X-prolyl dipeptidyl aminopeptidase | 2926 |
| L2221 | X-prolyl dipeptidyl aminopeptidase | 2927 |
| L2222 | X-prolyl dipeptidyl aminopeptidase | 2928 |
| L2223 | X-prolyl dipeptidyl aminopeptidase | 2929 |
| L2224 | X-prolyl dipeptidyl aminopeptidase | 2930 |
| L2225 | X-prolyl dipeptidyl aminopeptidase | 2931 |
| L2226 | X-prolyl dipeptidyl aminopeptidase | 2932 |
| L2227 | X-prolyl dipeptidyl aminopeptidase | 2933 |
| L2228 | X-prolyl dipeptidyl aminopeptidase | 2934 |
| L2229 | X-prolyl dipeptidyl aminopeptidase | 2935 |
| L2230 | X-prolyl dipeptidyl aminopeptidase | 2936 |
| L2231 | X-prolyl dipeptidyl aminopeptidase | 2937 |
| L2232 | X-prolyl dipeptidyl aminopeptidase | 2938 |
| 12233 | Xylosidase/arabinosidase | 2939 |
| L2234 | Xylosidase/arabinosidase | 2940 |
| L2235 | Xylosidase/arabinosidase | 2941 |
| L2236 | Xylosidase/arabinosidase | 2942 |
| L2237 | Xylosidase/arabinosidase | 2943 |
| L2238 | Xylosidase/arabinosidase | 2944 |
| L2239 | Xylosidase/arabinosidase | 2945 |
| L2240 | YkoF | 2946 |
| L2241 | YkuI protein | 2947 |

Internal ribosomal entry site (IRES) is a nucleotide sequence (<500 nucleotides) that allows for initiation of translation in the middle of an mRNA sequence (Kim, J. H. et al., 2011. PLoS One 6(4): e18556; the contents of which are herein incorporated by reference in its entirety). Use of an IRES sequence ensures co-expression of genes before and after the IRES, though the sequence following the IRES may be transcribed and translated at lower levels than the sequence preceding the IBES sequence.

2A peptides are small "self-cleaving" peptides (18-22 amino acids) derived from viruses such as foot-and-mouth disease virus (F2A), porcine teschovirus-1 (P2A), Thoseaassigna virus (T2A), or equine rhinitis A vines (E2A). The 2A designation refers specifically to a region of picornavirus polyproteins that lead to a ribosomal skip at the glycylprolyl bond in the C-terminus of the 2A peptide (Kim, J. H. et al., 2011. PLoS One 6(4): e18556; the contents of which are herein incorporated by reference in its entirety). This skip results in a cleavage between the 2A peptide and its immediate downstream peptide. As opposed to IRES linkers, 2A peptides generate stoithiometric expression of proteins flanking the 2A peptide and their shorter length can be advantageous in generating viral expression vectors.

Some payload regions encode linkers comprising furin cleavage sites. Furin is a calcium dependent serine endoprotease that cleaves proteins just downstream of a basic amino acid target sequence (Arg-X-(Arg/Lys)-Arg) (Thomas, G., 2002. Nature Reviews Molecular Cell Biology 3(10): 753-66; the contents of which are herein incorporated reference in its entirety). Furin is enriched in the trans-golgi network where it is involved in processing cellular precursor proteins. Furin also plays a role in activating a number of pathogens. This activity can be taken advantage of for expression of polypeptides of the invention.

In some embodiments, the payload region may encode one or more linkers comprising cathepsin, matrix metalloproteinases or legumain cleavage sites. Such linkers are described e.g. by Cizeau and Macdonald in International Publication No. WO2008052322, the contents of which are herein incorporated in their entirety. Cathepsins are a family of proteases with unique mechanisms to cleave specific proteins. Cathepsin B is a cysteine protease and cathepsin D is an aspartyl protease. Matrix metalloproteinases are a family of calcium-dependent acid zinc-containing endopeptidases. Legumain is an enzyme catalyzing the hydrolysis of (-Asn-Xaa-) bonds of proteins and small molecule substrates.

In some embodiments, payload regions may encode linkers that are not cleaved. Such linkers may include a simple amino acid sequence, such as a glycine rich sequence. In some cases, linkers may comprise flexible peptide linkers comprising glycine and serine residues. The linker may comprise flexible peptide linkers of different lengths, e.g. nxG4S, where n=1-10 and the length of the encoded linker varies between 5 and 50 amino acids (SEQ ID NO: 17940). In a non-limiting example, the linker may be 5xG4S (SEQ ID NO: 17939 encoded by SEQ ID NO: 903). These flexible linkers are small and without side chains so they tend not to influence secondary protein structure while providing a flexible linker between antibody segments (George, R. A., et al., 2002. Protein Engineering 15(11): 871-9; Huston, J. S. et al., 1988. PNAS 85:5879-83 and Shan, D. et al., 1999. Journal of Immunology. 162(11):6589-95; the contents of each of which are herein incorporated by reference in their entirety). Furthermore, the polarity of the serine residues improves solubility and prevents aggregation problems.

In some embodiments, payload regions of the invention may encode small and unbranched serine rich peptide linkers, such as those described by Huston et al. in U.S. Pat. No. 5,525,491, the contents of which are herein incorporated in their entirety. Poly peptides encoded by the payload region of the invention, linked b serine-rich linkers, have increased solubility.

In some embodiments, payload regions of the invention may encode artificial linkers, such as those described by Whitlow and Filpula in U.S. Pat. No. 5,856,456 and Ladner et al. in U.S. Pat. No. 4,946,778, the contents of each of which are herein incorporated by their entirety.

Viral Genome Component: Introns

In one embodiment, the payload region comprises at least one element to enhance the expression such as one or more introns or portions thereof. Non-limiting examples of introns include, MVM (67-97 bps), F.IX truncated intron 1 (300 bps), β-globin SD/immunoglobulin heavy chain splice acceptor (250 bps), adenovirus splice donor/immunoglobin splice acceptor (500 bps), SV40 late splice donor/splice acceptor (19S/16S) (180 bps) and hybrid adenovirus splice donor/IgG splice acceptor (230 bps).

In one embodiment, the intron or intron portion may be 100-500 nucleotides in length. The intron may have a length of 80, 90, 100, 110, 120, 130, 140, 150, 160, 170, 171, 172, 173, 174, 175, 176, 177, 178, 179, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490 or 500. The intron may have a length between 80-100, 80-120, 80-140, 80-160, 80-180, 80-200, 80-250, 80-300, 80-350, 80-400, 80-450, 80-500, 200-300, 200-400, 200-500, 300-400, 300-500, or 400-500.

Payloads of the Invention

The AAV particles of the present disclosure comprise at least one payload region. As used herein, "payload" or "payload region" refers to one or more polynucleotides or polynucleotide regions encoded by or within a viral genome or an expression product of such polynucleotide or polynucleotide region, e.g., a transgene, a polynucleotide encoding a polypeptide or multi-polypeptide or a modulatory nucleic acid or regulatory nucleic acid. Payloads of the present invention typically encode polypeptides (e.g., antibodies or antibody-based compositions) or fragments or variants thereof.

The payload region may be constructed in such a way as to reflect a region similar to or mirroring the natural organization of an snRNA.

The payload region may comprise a combination of coding and non-coding nucleic acid sequences.

In some embodiments, the AAV payload region may encode a coding or non-coding RNA.

In one embodiment, the AAV particle comprises a viral genome with a payload region comprising nucleic acid sequences encoding more than one polypeptide of interest (e.g., an antibody). In such an embodiment, a viral genome encoding more than one polypeptide may be replicated and packaged into a viral particle. A target cell transduced with a viral particle comprising more than one polypeptide may express each of the polypeptides in a single cell.

In one embodiment, as shown in FIG. 1, an AAV particle comprises a viral genome with a payload region comprising a nucleic acid sequence encoding a heavy chain and a light chain of an antibody. The heavy chain and light chain are expressed and assembled to form the antibody which is secreted.

Figure 2:
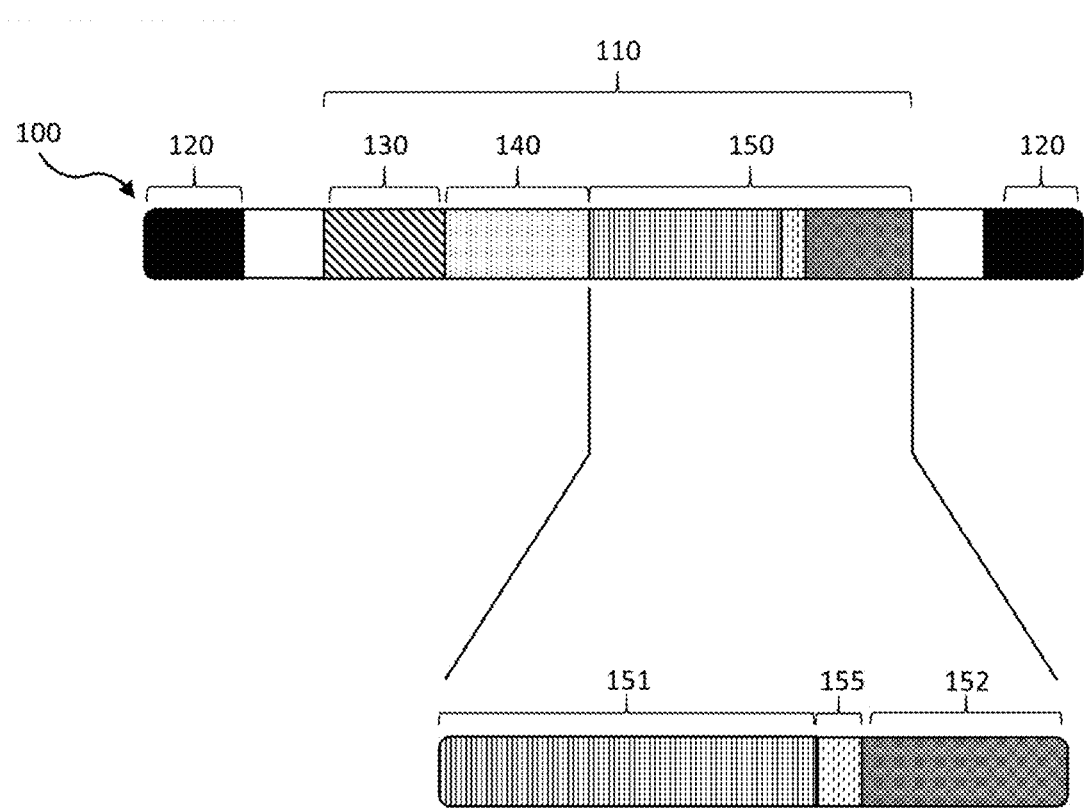
FIG. 2 is a schematic of a viral genome of the invention.

In one embodiment, the payload region may comprise the components as shown in FIG. 2. The payload region 110 is located within the viral genome 100. At the 5' and/or the 3' end of the payload region 110 there may be at least one inverted terminal repeat (ITR) 120. Within the payload region, there is a promoter region 130, an intron region 140 and a coding region 150. When the coding region 150 comprises a heavy chain region 151 and light chain region 152 of an antibody, the two chains may be separated by a linker region 155.

In one embodiment, the coding region may comprise a heavy and light chain sequence and a linker. As shown in FIG. 3, the payload region may comprise a heavy chain and light chain sequence separated by a linker and/or a cleavage site. In one embodiment, the heavy and light chain sequence is sequence separated by an TRES sequence (1 and 2). In one embodiment, the heavy and light chain sequence is separated by a foot and mouth virus sequence (3 and 4). In one embodiment, the heavy and light chain sequence is separated by a foot and mouth virus sequence and a thrill cleavage site (5 and 6). In one embodiment, the heavy and light chain sequence is separated by a porcine teschovirus-1 virus sequence (7 and 8). In one embodiment, the heavy and light chain sequence is separated by a porcine teschovirus-1 virus and a fur in cleavage site (9 and 10). In one embodiment, the heavy and light chain sequence is separated by a 5xG4S sequence (SEQ ID NO: 17939) (11).

Where the AAV particle payload region encodes a polypeptide, the polypeptide may be a peptide or protein. A protein encoded by the AAV particle payload region may comprise an antibody, an antibody related composition, a secreted protein, an intracellular protein, an extracellular protein, and/or a membrane protein. The encoded proteins may be structural or functional. In addition to the antibodies or antibody-based composition, proteins encoded by the payload region may include, in combination, certain mammalian proteins involved in immune system regulation. The AAV viral genomes encoding poly peptides described herein may be useful in the fields of human disease, viruses, infections veterinary applications and a variety of in vivo and in vitro settings.

In some embodiments, the AAV particles are useful in the field of medicine for the treatment, prophylaxis, palliation or amelioration of neurological diseases and/or disorders.

Antibodies and Antibody-Based Compositions

Payload regions of the AAV particles of the invention may encode polypeptides that form one or more functional antibodies or antibody-based compositions. As used herein, the term "antibody" is referred to in the broadest sense and specifically covers various embodiments including, but not limited to monoclonal antibodies, polyclonal antibodies, multispecific antibodies (e.g. bispecific antibodies formed from at least two intact antibodies), and antibody fragments (e.g., diabodies) so long as they exhibit a desired biological activity (e.g., "functional"). Antibodies are primarily amino-acid based molecules but may also comprise one or more modifications (including, but not limited to the addition of sugar moieties, fluorescent moieties, chemical tags, etc.).

As used herein, "antibody-based" or "antibody-derived" compositions are monomeric or multi-merit polypeptides which comprise at least one amino-acid region derived from a known or parental antibody sequence and at least one amino acid region derived from a non-antibody sequence, e.g., mammalian protein.

Payload regions may encode polypeptides that form or function as any antibody, including antibodies that are known in the art and/or antibodies that are commercially available. The encoded antibodies may be therapeutic, diagnostic, or for research purposes. Further, polypeptides of the invention may include fragments of such antibodies or antibodies that have been developed to comprise one or more of such fragments (e.g., variable domains or complementarily determining regions (CDRs)).

In one embodiment, the viral genonie of the AAV particles may comprise nucleic acids which have been engineered to enable expression of antibodies, antibody fragments, or components of any of those described in U.S. Pat. No. 7,041,807 related to YYX epitope; US20090175884, US20110305630, US20130330275 related to misfolded proteins in cancer; US20040175775 related to PrP in eye fluid, US20030114360 related to copolymers and methods of treating prion-related diseases; WO2009121176 insulin-induced gene peptide compositions; US20030022243; WO2003000853 related to protein aggregation assays; WO200078344 related to prion protein peptides and uses thereof. Each of these publications are incorporated by reference in their entireties.

Antibody Generation

In some embodiments, viral genomes of the AAV particles of the invention may encode antibodies or antibody-based compositions produced using methods known in the art. Such methods may include, but are not limited to immunization and display technologies (e.g., phage display, yeast display, and ribosomal display). Antibodies may be developed, for example, using any naturally occurring or synthetic antigen. As used herein, an "antigen" is an entity which induces or evokes an immune response in an organism. An immune response is Characterized by the reaction of the cells, tissues and/or organs of an organism to the presence of a foreign entity. Such an immune response typically leads to the production by the organism of one or more antibodies against the foreign entity, e.g., antigen or a portion of the antigen. As used herein, "antigens" also refer to binding partners for specific antibodies or binding agents in a display library.

In one embodiment, the sequences of the polypeptides to be encoded in the viral genomes of the invention may be derived from antibodies produced using hybridoma technology. Host animals (e.g. mice, rabbits, goats, and llamas) may be immunized by an injection with an antigenic protein to elicit lymphocytes that specifically bind to the antigen. Lymphocytes may be collected and fused with immortalized cell lines to generate hybridomas which can be cultured in a suitable culture medium to promote growth. The antibodies produced by the cultured hybridomas may be subjected to analysis to determine binding specificity of the antibodies for the target antigen. Once antibodies with desirable characteristics are identified, corresponding hybridomas may be subcloned through limiting dilution procedures and grown by standard methods. The antibodies produced by these cells may be isolated and purified using standard immunoglobulin purification procedures.

In one embodiment, the sequences of the polypeptides to be encoded in the viral genomes of the invention may be produced using heavy and light chain variable region cDNA sequences selected from hybridomas or from other sources. Sequences encoding antibody variable domains expressed by hybridomas may be determined by extracting RNA molecules from antibody-producing hybridoma cells and producing cDNA by reverse transcriptase polymerase chain reaction (PCR). PCR may be used to amplify cDNA using primers specific for heavy and light chain sequences. PCR products may then be subcloned into plasmids for sequence analysis. Antibodies may be produced by insertion of resulting variable domain sequences into expression vectors.

In one embodiment, the sequences of the polypeptides to be encoded in the viral genomes of the invention may be generated using display technologies. Display technologies used to generate polypeptides of the invention may include any of the display techniques (e.g. display library screening techniques) disclosed in International Patent Application No. WO2014074532, the contents of which are herein incorporated by reference in their entirety. In some embodiments, synthetic antibodies may be designed, selected or optimized by screening target antigens using display technologies (e.g. phage display technologies). Phage display libraries may comprise millions to billions of phage particles, each expressing unique antibody fragments on their viral coats. Such libraries may provide richly diverse resources that may be used to select potentially hundreds of antibody fragments with diverse levels of affinity for one or more antigens of interest (McCafferty, et al., 1990. Nature, 348:552-4; Edwards, B. M. et al., 2003. JMB. 334: 103-18; Schofield, D. et al., 2007. Genome Biol. 8, R254 and Pershad, K. et al., 2010. Protein Engineering Design and Selection. 23:279-88; the contents of each of which are herein incorporated by reference in their entirety). Often, the antibody fragments present in such libraries comprise scfv antibody fragments, comprising a fusion protein of $V_H$ and $V_L$ antibody domains joined by a flexible linker. In some cases, says may contain the same sequence with the exception of unique sequences encoding variable loops of the CDRs. In some cases, scFvs are expressed as fusion proteins, linked to viral coat proteins (e.g. the N-terminus of the viral pIII coat protein). $V_L$ chains may be expressed separately for assembly with chains in the periplasm prior to complex incorporation into viral coats. Precipitated library members may be sequenced from the bound phage to obtain cDNA encoding desired scFvs. Antibody variable domains or CDRs from such sequences may be directly incorporated into antibody sequences for recombinant antibody production, or mutated and utilized for further optimization through in vitro affinity maturation.

In one embodiment, the sequences of the polypeptides to be encoded in the viral genomes of the invention may be produced using yeast surface display technology, wherein antibody variable domain sequences may be expressed on the cell surface of *Saccharomyces cerevisiae*. Recombinant antibodies may be developed by displaying the antibody fragment of interest as a fusion to e.g. Aga2p protein on the surface of the yeast, where the protein interacts with proteins and small molecules in a solution says with affinity towards desired receptors mar be isolated from the yeast surface using magnetic separation and flow cytometry. Several cycles of yeast surface display and isolation may be done to attain scFvs with desired properties through directed evolution.

In one embodiment, the sequence of the polypeptides to be encoded in the viral genomes of the invention (e.g., antibodies) may be designed by VERSITOPE™ Antibody Generation and other methods used by BIOATLA® and described in United States Patent Publication No. US20130281303, the contents of which are herein incorporated by reference in their entirety. In brief, recombinant monoclonal antibodies are derived from B-cells of a host immuno-challenged with one or more target antigens. These methods of antibody generation do not rely on immortalized cell lines, such as hybridoma, thereby avoiding some of the associated challenges i.e., genetic instability and low production capacity, producing high affinity and high diversity recombinant monoclonal antibodies. In one embodiment, the method is a natural diversity approach. In another embodiment, the method is a high diversity approach.

In one embodiment, the sequences of the polypeptides to be encoded in the viral genomes of the invention may be generated using BIOATLA® natural diversity approach. In the natural diversity approach of generating recombinant monoclonal antibodies described in United States Patent Publication No. US20130281303, the original pairings of variable heavy ($V_H$) and variable light ($V_L$) domains are retained from the host, yielding recombinant monoclonal antibodies that are naturally paired. These may be advantageous due to a higher likelihood of functionality as compared to non-natural pairings of $V_H$ and $V_L$. To produce the recombinant monoclonal antibodies, first a non-human host (i.e., rabbit, mouse, hamster, guinea pig, camel or goat) is immuno-challenged with an antigen of interest. In some embodiments, the host may be a previously challenged human patient. In other embodiments, the host may not have been immuno-challenged. B-cells are harvested from the host and screened by fluorescence activated cell sorting (FACS), or other method, to create a library of B-cells enriched in B-cells capable of binding the target antigen. The cDNA obtained from the mRNA of a single B-cell is then amplified to generate an immunoglobulin library of $V_H$ and $V_L$ domains. This library of immunoglobulins is then cloned into expression vectors capable of expressing the $V_H$ and $V_L$ domains, wherein the $V_H$ and $V_L$ domains remain naturally paired. The library of expression vectors is then used in an expression system to express the $V_H$ and $V_L$ domains in order to create an antibody library. Screening of the antibody library yields antibodies able to bind the target antigen, and these antibodies can be further characterized. Characterization may include one or more of the following: isoelectric point, thermal stability, sedimentation rate, folding rate, neutralization or antigen activity, antagonist or agonistic activity, expression level, specific and non-specific binding, inhibition of enzymatic activity, rigidity/flexibility, shape, charge, stability across pH, in solvents, under UV radiation, in mechanical stress conditions, or in some conditions, half-life and glycosylation.

In one embodiment, the sequences of the polypeptides to be encoded in the viral genomes of the invention may be generated using BIOATLA® high diversity approach. In the high diversity approach of generating recombinant monoclonal antibodies described in United States Patent Publication No. US20130281303, additional pairings of variable heavy ($V_H$) and variable light ($V_L$) domains are attained. To produce the recombinant monoclonal antibodies, B-cells harvested from the host are screened by fluorescence activated cell sorting (FACS), panning, or other method, to create a library of B-cells enriched in B-cells capable of binding the target antigen. The cDNA obtained from the mRNA of the pooled B-cells is then amplified to generate an immunoglobulin library of $V_H$ and $V_L$ domains. This library of immunoglobulins is then used in a biological display system (mammalian, yeast or bacterial cell surface display systems) to generate a population of cells displaying antibodies, fragments or derivatives comprising the $V_H$ and $V_L$ domains wherein, the antibodies, fragments or derivatives comprise $V_H$ and $V_L$ domain combinations that were not present in the B-cells in vivo. Screening of the cell population by FACS, with the target antigen, yields a subset of cells capable of binding the target antigen and the antibodies displayed on these cells can be further characterized. In an alternate embodiment of the high diversity approach, the immunoglobulin library comprises only $V_H$ domains obtained from the B-cells of the immuno-challenged host, while the $V_L$ domain(s) are obtained from another source.

In one embodiment, the sequences of the polypeptides to be encoded in the viral genomes of the invention may be evolved using BIOATLA® comprehensive approaches. The methods of generating recombinant monoclonal antibodies as described in United States Patent Publication No. US20130281303, further comprises evolving the recombinant antibody by comprehensive positional evolution (CPE™), CPE™ followed by comprehensive protein synthesis (CPS™), PCR shuffling, or other method.

In one embodiment, the sequence of the polypeptides to be encoded in the viral genomes of the invention (e.g., antibodies) may be derived from any of the BIOATLA® protein evolution methods described in International Publication WO2012009026, the contents of which are herein incorporated by reference in their entirety. In this method, mutations are systematically performed throughout the polypeptide or molecule of interest, a map is created providing useful informatics to guide the subsequent evolutionary steps. Not wishing to be bound by theory, these evolutionary methods typically start with a template polypeptide and a mutant is derived therefrom, which has desirable properties or characteristics. Non-limiting examples of evolutionary techniques include polymerase chain reaction (PCR), error prone PCR, oligonucleotide-directed mutagenesis, cassette mutagenesis, shuffling, assembly PCR, sexual PCR mutagenesis, in vivo mutagenesis, site-specific mutagenesis, gene reassembly, gene site saturated mutagenesis, in vitro mutagenesis, ligase chain reaction, oligonucleotide synthesis or any combination thereof.

In one embodiment, the BIOATLA® evolution method is Comprehensive Positional Evolution (CPE™). CPE, naturally occurring amino acid variants are generated for each of the codons of the template polypeptide, wherein 63 different codon options exist for each amino acid variant. A set of polypeptides with single amino acid mutations are generated and the mutations are then confirmed by sequencing or other method known in the art and each amino acid change screened for improved function, neutral mutations, inhibitory mutations, expression and compatibility with the host system. An EvoMap™ is created that describes in detail the effects of each amino acid mutation on the properties and characteristics of that polypeptide. The data from the EvoMap™ may be utilized to produce polypeptides with more than one amino acid mutation, wherein the resultant multi-site mutant polypeptides can be screened for desirable characteristics.

In one embodiment, the BIOATLA® evolution method is Synergy Evolution, wherein an EvoMap™ is used to identify amino acid positions to introduce 2-20 mutations simultaneously to produce a combinatorial effect. The resulting multi-site mutant polypeptides may be screened on one or more pre-determined characteristics to identify "upmutants" wherein the function of the mutant is improved as compared to the parent polypeptide. In one embodiment, Synergy Evolution is used to enhance binding affinity of an antibody.

In one embodiment, the BIOATLA® evolution method is Flex Evolution, wherein an EvoMap™ is used to identify fully mutable sites within a polypeptide that may then be targeted for alteration, such as introduction of glycosylation sites or chemical conjugation.

In one embodiment, the BIOATLA® evolution method is Comprehensive Positional Insertion Evolution (CPI™), wherein an amino acid is inserted after each amino acid of a template polypeptide to generate a set of lengthened polypeptides. CPI may be used to insert 1, 2, 3, 4, or 5 amino acids at each new position. The resultant lengthened polypeptides are sequenced and assayed for one or more pre-determined properties and evaluated in comparison to its template or parent molecule. In one embodiment, the binding affinity and immunogenicity of the resultant polypeptides are assayed. In one embodiment, the lengthened polypeptides are further mutated and mapped to identify polypeptides with desirable characteristics.

In one embodiment, the BIOATLA® evolution approach is Comprehensive Positional Deletion Evolution (CPD™), wherein each amino acid of the template polypeptide is individually and systematically deleted one at a time. The resultant shortened polypeptides are then sequenced and evaluated by assay for at least one pre-determined feature. In one embodiment, the shortened polypeptides are further mutated and mapped to identify polypeptides with desirable characteristics.

In one embodiment, the BIOATLA® evolution approach is Combinatorial Protein Synthesis (CPS™), wherein mutants identified in CPE, CPI, CPD or other evolutionary technique are combined for polypeptide synthesis. These combined mutant polypeptides are then screened for enhanced properties and characteristics. In one embodiment CPS is combined with any of the aforementioned evolutionary or polypeptide synthesis methods.

In one embodiment, the sequence of the polypeptides to be encoded in the viral genomes of the invention (e.g., antibodies) may be derived from the BIOATLA® Comprehensive integrated Antibody Optimization (CIAO!™) described in U.S. Pat. No. 8,859,467 the contents of which are herein incorporated by reference in their entirety. The CIAO!™ method allows for simultaneous evolution of polypeptide performance and expression optimization, within a eukaryotic cell host (i.e., mammalian or yeast cell host). First, an antibody library is generated in a mammalian cell production host by antibody cell surface display, wherein the generated antibody library targets a particular antigen of interest. The antibody library is then screened by any method known in the art, for one or more properties or characteristics. One or more antibodies of the library, with desirable properties or characteristics are chosen for further polypeptide evolution by any of the methods known in the art, to produce a library of mutant antibodies by antibody cell surface display in a mammalian cell production host. The generated mutant antibodies are screened for one or more predetermined properties or characteristics, whereby an upmutant is selected, wherein the upmutant has enhanced or improved characteristics as compared to the parent template polypeptide.

In one embodiment, the sequences of the polypeptides to be encoded in the viral genomes of the invention may be humanized by the methods of BIOATLA® as described in United States Patent Publication US20130303399, the contents of which are herein incorporated by reference in their entirety. In this method, for generating enhanced full length humanized antibodies in mammalian cells, no back-mutations are required to retain affinity to the antigen and no CDR grafting or phage-display is necessary. The generated humanized antibody has reduced immunogenicity and equal or greater affinity for the target antigen as compared to the parent antibody. The variable regions or CDRs of the generated humanized antibody are derived from the parent or template, whereas the framework and constant regions are derived from one or more human antibodies. To start, the parent or template antibody is selected, cloned and each CDR sequence identified and synthesized into a CDR fragment library. Double stranded DNA fragment libraries for $V_H$ and $V_L$ are synthesized from the CDR fragment encoding libraries, wherein at least one CDR fragment library is derived from the template antibody and framework (FW) fragment encoding libraries, wherein the FW fragment library is derived from a pool of human frameworks obtained from natively expressed and functional human antibodies. Stepwise liquid phase ligation of FW and CDR encoding fragments is then used to generate both $V_H$ and $V_L$ fragment libraries. The $V_H$ and $V_L$ fragment libraries are then cloned into expression vectors to create a humanization library, which is further transfected into cells for expression of full length humanized antibodies, and used to create a humanized antibody library. The humanized antibody library is then screened to determine expression level of the humanized antibodies, affinity or binding ability for the antigen, and additional improved or enhanced characteristics, as compared to the template or parent antibody. Non-limiting examples of characteristics that may be screened include equilibrium dissociation constant ($K_D$), stability, melting temperature ($T_m$), pI, solubility, expression level, reduced immunogenicity and improved effector function.

In one embodiment, the sequences of the polypeptides to be encoded in the viral genomes of the invention may be generated by the BIOATLA® method for preparing conditionally active antibodies as described in International Publications WO2016033331 and WO2016036916, the contents of which are herein incorporated by reference in their entirely. As used herein, the term "conditionally active" refers to a molecule that is active at an aberrant condition. Further, the conditionally active molecule may be virtually inactive at normal physiological conditions. Aberrant conditions may result from changes in temperature, osmotic pressure, osmolality, oxidative stress, electrolyte concentration, and/or chemical or proteolytic resistance, as non-limiting examples.

The method of preparing a conditionally active antibody is described in International Publications WO2016033331 and WO2016036916 and summarized herewithin. Briefly, a wild-type polypeptide is selected and the DNA is evolved to create mutant DNAs. Non-limiting examples of evolutionary techniques that may be used to evolve the DNA include polymerase chain reaction (PCR), error prone PCR, shuffling, oligonucleotide-directed mutagenesis, assembly PCR, sexual PCR mutagenesis, in vivo mutagenesis, site-specific mutagenesis, gene reassembly, gene site saturated mutagenesis, in vitro mutagenesis, ligase chain reaction, oligonucleotide synthesis or any combination thereof. Once mutant DNAs are created, they are expressed in a eukaryotic cell production host (i.e., fitngal, insect, mammalian, adenoviral, plant), wherein a mutant polypeptide is produced. The mutant polypeptide and the corresponding wild-type polypeptide are then subjected to assays under both normal physiological conditions and aberrant conditions in order to identify mutants that exhibit a decrease in activity in the assay at normal physiological conditions as compared to the wild-type polypeptide and/or an increase in activity in the assay under aberrant conditions, as compared to the corresponding wild-type polypeptide. The desired conditionally active mutant may then be produced in the aforementioned eukaryotic cell production host.

In one embodiment, the conditionally active antibody is a "mirac protein" as described by BIOATLA® in U.S. Pat.

No. 8,709,755, the contents of which are herein incorporated by reference in their entirety. As used herein "mirac protein" refers to a conditionally active antibody that is virtually inactive at body temperature but active at lower temperatures.

In one embodiment, the sequence of the polypeptides to be encoded in the viral genomes of the invention (e.g., antibodies) may be derived based on any of the BIOATLA™ methods including, but not limited to, VERSITOPE™ Antibody Generation, natural diversity approaches and high diversity approaches for generating monoclonal antibodies, methods for generation of conditionally active polypeptides, humanized antibodies, mirac proteins, multi-specific antibodies or cross-species active mutant polypeptides, Comprehensive Integrated Antibody Optimization (CIAO Tim Comprehensive Positional Evolution (CPE™), Synergy Evolution, Flex Evolution, Comprehensive Positional insertion Evolution (CPI™). Comprehensive Positional Deletion Evolution (CPD™), Combinatorial Protein Synthesis (CPS™), or any combination thereof. These methods are described in U.S. Pat. Nos. 8,859,467 and 8,709,755 and United States Publication Nos. US20130281303, US20130303399, US20150065690, US20150252119, US20150086562 and US20100138945, and International Publication Nos. WO2015105888, WO2012009026, WO2011109726, WO2016036916, and WO2016033331, the contents of each of which are herein incorporated by reference in their entirety.

Antibody Fragments and Variants

In some embodiments, antibody fragments encoded by payloads of the invention comprise antigen binding regions from intact antibodies. Examples of antibody fragments may include, but are not limited to Fab, Fab', F(ab')$_2$, and Fv fragments; diabodies; linear antibodies; single-chain antibody molecules; and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')$_2$ fragment that has two antigen-binding sites and is still capable of cross-linking antigen. Compounds and/or compositions of the present invention may comprise one or more of these fragments. For the purposes herein, an "antibody" may comprise a heavy and light variable domain as well as an Fc region.

In one embodiment, the Fc region may be a modified Fc region, as described in US Patent Publication US20150065690, wherein the Fc region may have a single amino acid substitution as compared to the corresponding sequence for the wild-type Fc region, wherein the single amino acid substitution yields an Fc region with preferred properties to those of the wild-type Fc region. Non-limiting examples of Fc properties that may be altered by the single amino acid substitution include bind properties or response to pH conditions.

As used herein, the term "native antibody" refers to an usually heterotetrameric glycoprotein of about 150,000 Daltons, composed of two identical light (L) chains and two identical heavy (H) chains. Genes encoding antibody heavy and light chains are known and segments making up each have been well characterized and described (Matsuda, F. et al., 1998. The Journal of Experimental Medicine. 188(11); 2151-62 and Li, A. et al., 2004. Blood. 103(12: 4602-9, the content of each of which are herein incorporated by reference in their entirety). Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain ($V_H$) followed by a number of constant domains. Each light chain has a variable domain at one end ($V_L$) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains found on both the antibody heavy and light chains that differ extensively in sequence among antibodies and are used in the binding and specificity of each particular antibody for its particular antigen. Variable domains comprise hypervariable regions. As used herein, the term "hypervariable region" refers to a region within a variable domain comprising amino acid residues responsible for antigen binding. The amino acids present within the hypervariable regions determine the structure of the complementarily determining regions (CDRs) that become part of the antigen-binding site of the antibody. As used herein, the term "CDR" refers to a region of an antibody comprising a structure that is complimentary to its target antigen or epitope. Other portions of the variable domain, not interacting with the antigen, are referred to as framework (FW) regions. The antigen-binding site (also known as the antigen combining site or paratope) comprises the amino acid residues necessary to interact with a particular antigen. The exact residues making up the antigen-binding site are typically elucidated by co-crystallography with bound antigen, however computational assessments can also be used based on comparisons with other antibodies (Strohl, W. R. Therapeutic Antibody Engineering. Woodhead Publishing, Philadelphia Pa. 2012. Ch. 3, p47-54, the contents of which are herein incorporated by reference in their entirety). Determining residues making up CDRs may include the use of numbering schemes including, but not limited to, those taught by Kabat [Wu, T. T. et al., 1970, JEM, 132(2):211-50 and Johnson, G. et al., 2000, Nucleic Acids Res. 28(1): 214-8, the contents of each of which are herein incorporated by reference in their entirety], Chothia [Chothia and Lesk, J. Mol. Biol. 196, 901 (1987). Chothia et al., Nature 342, 877 (1989) and Al-Lazikani, B. et al., 1997, J. Mol. Biol. 273(4):927-48, the contents of each of which are herein incorporated by reference in their entirety], Lefranc (Lefranc, M. P. et al., 2003, Immuno Res. 1:3) and Honegger (Honegger, A. and Pluckthun, A. 2001. J. W. Biol. 309(3): 657-70, the contents of which are herein incorporated by reference in their entirety).

$V_H$ and $V_L$ domains have three CDRs each. $V_L$ CDRs are referred to herein as CDR-L1, CDR-L2 and CDR-L3, in order of occurrence when moving from N- to C-terminus along the variable domain polypeptide. CDRs are referred to herein as CDR-H1, CDR-H2 and CDR-H3, in order of occurrence when moving from N- to C-terminus along the variable domain polypeptide. Each of CDRs have favored canonical structures with the exception of the CDR-H3, which comprises amino acid sequences that may be highly variable in sequence and length between antibodies resulting in a variety of three-dimensional structures in antigen-binding domains (Nikoloudis, D. et al., 2014. Peer J. 2:e456: the contents of which are herein incorporated by reference in their entirety). In some cases, CDR-H3s may be analyzed among a panel of related antibodies to assess antibody diversity. Various methods of determining CDR sequences are known in the art and may be applied to known antibody sequences (Strobl W. R. Therapeutic Antibody Engineering. Woodhead Publishing, Philadelphia Pa. 2012. Ch. 3, p47-54, the contents of which are herein incorporated by reference in their entirety).

As used herein, the term "Fv" refers to an antibody fragment comprising the minimum fragment on an antibody needed to form a complete antigen-binding site. These regions consist of a dimer of one heavy chain and one light chain variable domain in tight, non-covalent association. Fv fragments can be generated by proteolytic cleavage, but are largely unstable. Recombinant methods are known in the art for generating stable Fv fragments, typically through insertion of a flexible linker between the light chain variable domain and the heavy chain variable domain [to form a single chain F (scFv)] or through the introduction of a disulfide bridge between heavy and light chain variable domains (Strohl, W. R. Therapeutic Antibody Engineering. Woodhead Publishing, Philadelphia Pa. 2012. Ch. 3, p46-47, the contents of which are herein incorporated by reference in their entirety).

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), IgG2, IgG3, IgG4, IgA, and IgA2.

As used herein, the term "single chain Fv" or "scFv" refers to a fusion protein of $V_H$ and $V_L$ antibody domains, wherein these domains are linked together into a single polypeptide chain by a flexible peptide linker. In some embodiments, the Fv polypeptide linker enables the say to form the desired structure for antigen binding. In some embodiments, scFvs are utilized in conjunction with phage display, yeast display or other display methods where they may be expressed in association with a surface member (e.g. phage coat protein) and used in the identification of high affinity peptides for a raven antigen.

As used herein, the term "bispecific antibody" refers to an antibody capable of binding two different antigens. Such antibodies typically comprise regions from at least two different antibodies. Bispecific antibodies may include any of those described in Riethmulier, G. 2012. Cancer Immunity. 12:12-18, Marvin, J. S. et al., 2005. Acta Pharmacologica Sinica. 26(6):649-58 and Schaefer, W. et al., 2011. PNAS. 108(27):11187-92, the contents of each of which are herein incorporated by reference in their entirety.

As used herein, the term "diabody" refers to a small antibody fragment with two antigen-binding sites. Diabodies comprise a heavy chain variable domain $V_H$ connected to a light chain variable domain $V_L$ in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (Hollinger, P. et al., "Diabodies" Small bivalent and bispecific antibody fragments. PNAS. 1993. 90:6444-8) the contents of each of which are incorporated herein by reference in their entirety.

The term "intrabody" refers to a form of antibody that is not secreted from a cell in which it is produced, but instead targets one or more intracellular proteins. Intrabodies may be used to affect a multitude of cellular processes including, but not limited to intracellular trafficking, transcription, translation, metabolic processes, proliferative signaling and cell division. In some embodiments, methods of the present invention may include intrabody-based therapies. In some such embodiments, variable domain sequences and/or CDR sequences disclosed herein may be incorporated into one or more constructs for intrabody-based therapy.

As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

As used herein, the term "humanized antibody" refers to a chimeric antibody comprising a minimal portion from one or more non-human (e.g., murine) antibody source(s) with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity.

In some embodiments, viral genomes of the present invention may encode antibody mimetics. As used herein, the term "antibody mimetic" refers to ally molecule which mimics the function or effect of an antibody and which hinds specifically and with high affinity to their molecular targets. In some embodiments, antibody mimetics may be monobodies, designed to incorporate the fibronectin type III domain (Fn3) as a protein scaffold (U.S. Pat. Nos. 6,673, 901; 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide regions.

As used herein, the term "antibody variant" refers to a modified antibody (in relation to a native or starting antibody) or a biomolecule resembling a native or starting antibody in structure and/or function (e.g., an antibody mimetic). Antibody variants may be altered in their amino acid sequence, composition or structure as compared to a native antibody. Antibody variants may include, but are not limited to, antibodies with altered isotypes (e.g., IgA, IgD, IgB, $IgG_1$, $IgG_2$, $IgG_3$, $IgG_4$, or IgM), humanized variants, optimized variants, multispecific antibody variants (e.g., bispecific variants), and antibody fragments.

The preparation of antibodies, whether monoclonal or polyclonal, is known in the art. Techniques for the production of antibodies are well known in the art and described, e.g. in Harlow and Lane "Antibodies, A Laboratory Manual", Cold Spring Harbor Laboratory Press, 1988; Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

Multispecific Antibodies

In some embodiments, payloads of the invention may encode antibodies that bind more than one epitope. As used herein, the terms "multibody" or "multispecific antibody" refer to an antibody wherein two or more variable regions bind to different epitopes. The epitopes may be on the same or different targets. In certain embodiments, a multi-specific antibody is a "bispecific antibody," which recognizes two different epitopes on the same or different antigens.

In one embodiment, multi-specific antibodies may be prepared by the methods used by BIOATLA® and described in international Patent publication WO201109726, the contents of which are herein incorporated by reference in their entirety. First a library of homologous, naturally occurring antibodies is generated by any method known in the art (i.e., mammalian cell surface display), then screened by FACS Aria or other screening method, for multi-specific antibodies that specifically bind to two or more target antigens. In one embodiment, the identified multi-specific antibodies are further evolved by any method known in the art, to produce a set of modified multi-specific antibodies. These modified multi-specific antibodies are screened for binding to the target antigens. In one embodiment, the multi-specific antibody may be further optimized by screening the evolved modified multi-specific antibodies for optimized or desired characteristics.

In one embodiment, multi-specific antibodies may be prepared by the methods used by BIOATLA® and described in Unites States Publication No. US20150252119, the contents of which are herein incorporated by reference in their entirety. In one approach, the variable domains of two parent antibodies, wherein the parent antibodies are monoclonal antibodies are evolved using any method known in the art in a manner that allows a single light chain to functionally complement heavy chains of two different parent antibodies. Another approach requires evolving the heavy chain of a single parent antibody to recognize a second target antigen. A third approach involves evolving the light chain of a parent antibody so as to recognize a second target antigen. Methods for polypeptide evolution are described in International Publication WO2012009026, the contents of which are herein incorporated by reference in their entirety, and include as non-limiting examples, Comprehensive Positional Evolution (CPE), Combinatorial Protein Synthesis (CPS), Comprehensive Positional Insertion (CPI), Comprehensive Positional Deletion (CPD), or any combination thereof. The Fc region of the multi-specific antibodies described in United States Publication No. US20150252119 may be created using a knob-in-hole approach, or any other method that allows the Fc domain to form heterodimers. The resultant multi-specific antibodies may be further evolved for improved characteristics or properties such as binding affinity for the target antigen.

Bispecific Antibodies

In some embodiments, payloads of the invention may encode bispecific antibodies. Bispecific antibodies are capable of binding two different antigens. Such antibodies typically comprise antigen-binding regions from at least two different antibodies. For example, a bispecific monoclonal antibody (BsMAb, BsAb) is an artificial protein composed of fragments of two different monoclonal antibodies, thus allowing the BsAb to bind to two different types of antigen.

In some cases, payloads encode bispecific antibodies comprising antigen-binding regions from two different antimu antibodies. For example, such bispecific antibodies may comprise binding regions from two different antibodies selected from Table 3.

Bispecific antibody frameworks may include any of those described in Riethmuller, G., 2012. *Cancer Immunity*. 12:12-18; Marvin, J. S. et al., 2005. *Acta Pharmacologica Sinica*. 26(6):649-58, and Schaefer, W. et al., 2011. *PNAS*. 108(27): 11187-92, the contents of each of which are herein incorporated by reference in their entirety.

New generations of BsMAb, called "trifunctional hispecific" antibodies, have been developed. These consist of two heavy and two light chains, one each from two different antibodies, where the two Fab regions (the arms) are directed against two antigens, and the Fc region (the foot) comprises the two heavy chains and forms the third binding site.

Of the two paratopes that form the tops of the variable domains of a bispecific antibody, one can be directed against a target antigen and the other against a T-lymphocyte antigen like CD3. In the case of trifunctional antibodies, the Fc region may additionally hind to a cell that expresses Fe receptors, like a macrophage, a natural killer (NK) cell or a dendritic cell. In sum, the targeted cell is connected to one or two cells of the immune system, which subsequently destroy it.

Other types of bispecific antibodies have been designed to overcome certain problems, such as short half-life, immunogenicity and side-effects caused by cytokine liberation. They include chemically linked Fabs, consisting only of the Fab regions, and various types of bivalent and trivalent single-chain variable fragments (scFvs), fusion proteins mimicking the variable domains of two antibodies. The furthest developed of these newer formats are the bi-specific T-cell engagers (BiTEs) and mAb2's, antibodies engineered to contain an Fcab antigen-binding fragment instead of the Fc constant region.

Using molecular genetics, two scFvs can be engineered in tandem into a single polypeptide, separated by a linker domain, called a "tandem scFv" (tascFv). TascFvs have been found to be poorly soluble and require refolding when produced in bacteria, or they may be manufactured in mammalian cell culture systems, which avoids refolding requirements but may result in poor yields. Construction of a tascFv with genes for two different scFvs yields a "bispecific single-chain variable fragments" (bis-scFvs). Only two tascFvs have been developed clinically by commercial firms; both are bispecific agents in active early phase development by Micromet for oncologic indications, and are described as "Bispecific T-cell Engagers (BiTE)." Blinatumomab is an anti-CD19/anti-CD3 bispecific tascFv that potentiates T-cell responses to B-cell non-Hodgkin lymphoma in Phase 2. MT110 is an anti-EP-CAM/anti-CD3 bispecific tascFv that potentiates T-cell responses to solid tumors in Phase T. Bispecific, tetravalent "TandAbs" are also being researched by Affimed (Nelson, A. L., *MAbs*. 2010. January-February; 2(1):77-83).

In some embodiments, payloads may encode antibodies comprising a single antigen-binding domain. These molecules are extremely small, with molecular weights approximately one-tenth of those observed for full-sized mAbs. Further antibodies may include "nanobodies" derived from the antigen-binding variable heavy chain regions ($V_{HHS}$) of heavy chain antibodies found in camels and llamas, which lack light chains (Nelson, A. L., *MAbs.* 2010. January-February; 2(1):77-83).

Disclosed and claimed in PCT Publication WO2014144573 to Memorial Sloan-Kettering Cancer Center are multimexization technologies for making dimeric multispecific binding agents (e.g., fusion proteins comprising antibody components) with improved properties over multispecific binding agents without the capability of dimerization.

In some cases, payloads of the invention may encode tetravalent bispecific antibodies (TetBiAbs as disclosed and claimed in PCT Publication WO2014144357). TetBiAbs feature a second pair of Fab fragments with a second antigen specificity attached to the C-terminus of an antibody, thus providing a molecule that is bivalent for each of the two antigen specificities. The tetravalent antibody is produced by genetic engineering methods, by linking an antibody heavy chain covalently to a Fab light chain, which associates with its cognate, co-expressed Fab heavy chain.

In some aspects, payloads of the invention may encode biosynthetic antibodies as described in U.S. Pat. No. 5,091,513, the contents of which are herein incorporated by reference in their entirety. Such antibody may include one or more sequences of amino acids constituting a region which behaves as a biosynthetic antibody binding site (BABS). The sites comprise 1) non-covalently associated or disulfide bonded synthetic $V_H$ and $V_L$ dimers. 2) $V_H$-$V_L$ or $V_L$-$V_H$ single chains wherein the $V_H$ and $V_L$ are attached by a polypeptide linker, or 3) individuals $V_H$ or $V_L$ domains. The binding domains comprise linked CDR and FR regions, which may be derived from separate immunoglobulins. The biosynthetic antibodies may also include other polypeptide sequences which function, e.g., as an enzyme, toxin, binding site, or site of attachment to an immobilization media or radioactive atom. Methods are disclosed for producing the biosynthetic antibodies, for designing BABS having any specificity that can be elicited by in vivo generation of antibody, and for producing analogs thereof.

In some embodiments, payloads may encode antibodies with antibody acceptor frameworks taught in U.S. Pat. No. 8,399,625. Such antibody acceptor frameworks may be particularly well suited accepting CDRs from an antibody of interest. In some cases, CDRs from anti-tau antibodies known in the art or developed according to the methods presented herein may be used.

Miniaturized Antibody

In one embodiment, the antibody encoded by the payloads of the invention may be a "miniaturized" antibody. Among the best examples of mAb miniaturization are the small modular immunopharmaceuticals (SMIPs) from Trubion Pharmaceuticals. These molecules, which can be monovalent or bivalent, are recombinant single-chain molecules containing one $V_L$, one $V_H$ antigen-binding domain, and one or two constant "effector" domains, all connected by linker domains. Presumably, such a molecule might offer the advantages of increased tissue or tumor penetration claimed by fragments while retaining the immune effector functions conferred by constant domains. At least three "miniaturized" SMIPs have entered clinical development. TRU-015, an anti-CD20 SMIP developed in collaboration with Wyeth, is the most advanced project, having progressed to Phase 2 for rheumatoid arthritis (RA). Earlier attempts in systemic lupus erythrematosus (SLE) and B cell lymphomas were ultimately discontinued. Trubion and Facet Biotechnology are collaborating in the development of TRU-016, an anti-CD37 SMIP, for the treatment of CLL and other lymphoid neoplasias, a project that has reached Phase 2. Wyeth has licensed the anti-CD20 SMIP SBI-087 for the treatment of autoimmune diseases, including RA, SLE and possibly multiple sclerosis, although these projects remain in the earliest stages of clinical testing. (Nelson, A. L., *MAbs.* 2010. January-February; 2(1):77-83).

Diabodies

In some embodiments, payloads of the invention may encode diabodies. Diabodies are functional hispecific single-chain antibodies (bscAb). These bivalent antigen-binding molecules are composed of non-covalent dimers of scFvs, and can be produced in mammalian cells using recombinant methods. (See, e.g., Mack et al, *Proc. Natl. Acad. Sci.,* 92: 7021-7025, 1995). Few diabodies have entered clinical development. An iodine-123-labeled diabody version of the anti-CEA chimeric antibody cT84.66 has been evaluated for pre-surgical immunoscintigraphic detection of colorectal cancer in a study sponsored by the Beckman Research Institute of the City of Hope (Clinicaltrials.gov NCT00647153) (Nelson, A. L., *MAbs.* 2010. January-February; 2(1):77-83).

Unibody

In some embodiments, payloads may encode a "unibody," in which the hinge region has been removed from IgG4 molecules. While IgG4 molecules are unstable and can exchange light-heavy chain heterodimers with one another, deletion of the hinge region prevents heavy chain-heavy chain pairing entirely, leaving highly specific monovalent light/heavy heterodimers, while retaining the Fc region to ensure stability and half-life, in vivo. This configuration may minimize the risk of immune activation or oncogenic growth, as IgG4 interacts poorly with FcRs and monovalent unibodies fail to promote intracellular signaling complex formation. These contentions are, however, largely supported by laboratory, rather than clinical, evidence. Other antibodies may be "miniaturized" antibodies, which are compacted 100 kDa antibodies (see, e.g., Nelson, A. L., *MAbs.* 2010. January-February; 2(1):77-83).

Intrabodies

In some embodiments, payloads of the invention may encode intrabodies. Intrabodies are a form of antibody that is not secreted from a cell in which it is produced, but instead targets one or more intracellular proteins. Intrabodies are expressed and function intracellularly, and may be used to affect a multitude of cellular processes including, but not limited to intracellular trafficking, transcription, translation, metabolic processes, proliferative signaling and cell division. In some embodiments, methods described herein include intrabody-based therapies. In some such embodiments, variable domain sequences and/or CDR sequences disclosed herein are incorporated into one or more constructs for intrabody-based therapy. For example, intrabodies may target one or more glycated intracellular proteins or may modulate the interaction between one or more glycated intracellular proteins and an alternative protein.

More than two decades ago, intracellular antibodies against intracellular targets were first described (Biocca, Neuberger and Cattaneo *EMBO J.* 9: 101-108, 1990). The intracellular expression of intrabodies in different compartments of mammalian cells allows blocking or modulation of the function of endogenous molecules (Biocca, et al., *EMBO*

J. 9: 101-108, 1990; Colby et al., Proc. Natl. Acad. Sci. U.S.A. 101: 17616-21, 2004). Intrabodies can alter protein folding, protein-protein, protein DNA, protein-RNA interactions and protein modification. They can induce a phenotypic knockout and work as neutralizing agents by direct binding to the target antigen, by diverting its intracellular trafficking or by inhibiting its association with binding partners. They have been largely employed as research tools and are emerging as therapeutic molecules for the treatment of human diseases such as viral pathologies, cancer and misfolding diseases. The fast growing bio-market of recombinant antibodies provides intrabodies with enhanced binding specificity, stability and solubility, together with lower immunogenicity, for their use in therapy (Biocca, abstract in Antibody Expression and Production Cell Engineering Volume 7, 2011, pp. 179-195).

In some embodiments, intrabodies have advantages over interfering RNA (iRNA); for example, iRNA has been shown to exert multiple non-specific effects, whereas intrabodies have been shown to have high specificity and affinity to target antigens. Furthermore, as proteins, intrabodies possess a much longer active half-life than iRNA. Thus, when the active half-life of the intracellular target molecule is long, gene silencing through iRNA may be slow to yield an effect, whereas the effects of intrabody expression can be almost instantaneous. Lastly, it is possible to design intrabodies to block certain binding interactions of a particular target molecule, while sparing others.

Intrabodies are often single chain variable fragments (scFvs) expressed from a recombinant nucleic acid molecule and engineered to be retained intracellularly (e.g., retained in the cytoplasm, endoplasmic reticulum, or periplasm). Intrabodies may be used, for example, to ablate the function of a protein to which the intrabody binds. The expression of intrabodies may also be regulated through the use of inducible promoters in the nucleic acid expression vector comprising the intrabody. Intrabodies may be produced for use in the viral genomes of the invention using methods known in the art, such as those disclosed and reviewed in: (Marasco et al., 1993 *Proc. Natl. Acad. Sci. USA*, 90: 7889-7893; Chen et of, 1994 *Hum. Gene Ther.* 5:595-601; Chen et al., 1994, *Proc. Natl. Acad. Sci. USA*, 91: 5932-5936; Maciejewski, et al., 1995, *Nature Med* 1: 667-673; Marasco, 1995, *Immunotech*, 1:1-19; Mhashilkar, et al., 1995, *EMBO J.* 14: 1542-51; Chen et al., 1996, *Hum. Gene Therap.*, 7: 1515-1525; Marasco, *Gene Ther.* 4:11-15, 1997; Rondon and Marasco, 1997, *Annu. Rev. Microbiol.* 51:257-283; Cohen, et al., 1998, *Oncogene* 17:2445-56; Proba et al., 1998, *J. Mol. Biol.* 275:245-253; Cohen et al., 1998, *Oncogene* 17:2445-2456; Hassanzadeh, et al., 1998, *FEBS Lett.* 437: 81-6; Richardson et al., 1998, *Gene Ther.* 5:635-44; Ohage and Steipe, 1999, *J. Mol. Biol.* 291:1119-1128; Ohage et al., 1999, *J. Mol. Biol.* 291:1129-1134; Wirtz and Steine, 1999, *Protein Sci.* 8:2245-2250; Zhu et al., 1999, *J. Immunol. Methods* 231:207-222; Arafat et al., 2000, *Cancer Gene Ther.* 7:1250-6; der Maur et al., 2002, *J. Biol. Chem.* 277:45075-85, Mhashilkar et al., 2002, *Gene Thar.* 9:307-19, and Wheeler et al., 2003, *FASEB J.* 17: 1733-5; and references cited therein). In particular, a CCR5 intrabody has been produced by Steinberger et al., 2000, *Proc. Natl. Acad Sci. USA* 97:805-810). See generally Marasco, Wash., 1998, "Intrabodies: Basic Research and Clinical Gene Therapy Applications" Springer: N.Y.; and for a review of says, see Pluckthun in "The Pharmacology of Monoclonal Antibodies," 1994, vol. 113. Rosenberg and Moore eds. Springer-Verlag, N.Y., pp. 269-315.

Sequences from donor antibodies may be used to develop intrabodies. Intrabodies are often recombinantly expressed as single domain fragments such as isolated VH and VL domains or as a single chain variable fragment (scFv) antibody within the cell. For example, intrabodies are often expressed as a single polypeptide to form a single chain antibody comprising, the variable domains of the heavy and light chains joined by a flexible linker polypeptide. Intrabodies typically lack disulfide bonds and are capable of modulating the expression or activity of target genes through their specific binding activity. Single chain antibodies can also be expressed as a single chain variable region fragment joined to the light chain constant region.

As is known in the art, an intrabody can be engineered into recombinant polynucleotide vectors to encode subcellular trafficking signals at its N or C terminus to allow expression at high concentrations in the sub-cellular compartments where a target protein is located. For example, intrabodies targeted to the endoplasmic reticulum (ER) are engineered to incorporate a leader peptide and, optionally, a C-terminal ER retention signal, such as the KDEL amino acid motif (SEQ ID NO: 17941). Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

There are certain technical challenges with intrabody expression. In particular, protein conformational folding and structural stability of the newly-synthesized intrabody within the cell is affected by reducing conditions of the intracellular environment.

Intrabodies of the invention may be promising therapeutic agents for the treatment of misfolding diseases, including Alzheimer's, Parkinson's, Huntington's and prion diseases, because of their virtually infinite ability to specifically recognize the different conformations of a protein, including pathological isoforms, and because they can be targeted to the potential sites of aggregation (both intra- and extracellular sites). These molecules can work as neutralizing agents against amyloidogenic proteins by preventing their aggregation, and/or as molecular shunters of intracellular traffic by rerouting the protein from its potential aggregation site (Cardinale, and Biocca, *Curr. Mol. Med.* 2008, 8:2-11).

Maxibodies

In one embodiment, the payloads of the invention encode a maxibody (bivalent say fused to the amino terminus of the Fc (CH2-CH:3 domains) of IgG.

Chimeric Antigen Receptors

In some embodiments, the polypeptides encoded by the viral genomes of the invention (e.g., antibodies) may be used to generate chimeric antigen receptors (CARs) as described by BIOATLA® in International Publications WO2016033331 and WO2016036916, the contents of which are herein incorporated by reference in their entirety. As used herein, a "chimeric antigen receptor (CAR)" refers to an artificial chimeric protein comprising at least one antigen specific targeting region (ASTR), wherein the antigen specific targeting region comprises a full-length antibody or a fragment thereof that specifically binds to a target antigen. The ASTR may comprise any of the following; a full length heavy or light chain, an Fab fragment, a single chain Fv fragment, a divalent single chain antibody, or a diabody. As a non-limiting example the ASTR of a CAR may be any of the antibodies listed in Tables 3-12, antibody-based compositions or fragments thereof. Any molecule that is capable of binding a target antigen with high affinity can be used in the ASTR of a CAR. In one embodiment, the CAR may have more than one ASTR. These ASTRs may target two or more antigens or two or more epitopes of the same antigen. In one embodiment, the CAR is conditionally active. In one embodiment, the CAR is used to produce a genetically engineered cytotoxic cell carrying the CAR and capable of targeting the antigen bound by the ASTR.

Chimeric antigen receptors (CARs) are particularly useful in the treatment of cancers, though also therapeutically effective in treatment of a wide variety of other diseases and disorders. Non-limiting examples of disease categories that may be treated with CARs or CAR-based therapeutics include autoimmune disorders. B-cell mediated diseases, inflammatory diseases, neuronal disorders, cardiovascular disease and circulatory disorders, or infectious diseases. Not wishing to be bound by theory, CARs traditionally work by targeting antigens presented on the surface of or on the inside of cells to be destroyed e.g., cancer tumor cells, by the cytotoxic cell of the CAR.

Senescent Cell Surface Protein Antibodies

In some embodiments, the AAV particles may comprise nucleic acids which have been engineered to express of antibodies that selectively bind to surface marker proteins of senescent cells. For example, the antibodies may selectively bind to proteins that are in misfolded conformation. The binding antibodies may reduce the number of senescent cells and be used to treat age-related conditions, such as, but not limited to, Alzheimer's disease, cardiovascular disease, emphysema, sarcopenia, and tumorigenesis as well as conditions more cosmetic in nature such as signs of skin aging including wrinkling, sagging, discoloration, age-related tissue dysfunction, tumor formation, and other age-related conditions.

In one embodiment, the expressed antibodies binding to epitopes of senescent cell surface proteins may be, but are not limited to, such as prion epitopes presented by SEQ ID NOs: 1-14 of international Publication No. WO2014186878; CD44 epitopes presented by SEQ ID NOs: 47-51 of International Publication No. WO2014186878; TNFR epitopes presented by SEQ ID NOs: 52-36 of International Publication No. WO2014186878; NOTCH1 epitope presented by SEQ ID NOs: 57-61 of International Publication No. WO2014186878; FasR epitopes presented by SEQ ID NOs: 62-66 of International Publication No. WO2014186878; epidermal growth factor epitopes presented by SEQ ID NOs: 67-81 of international Publication No. WO2014186878; CD 3S epitopes presented by SEQ ID NOs: 82-86 of International Publication No. WO2014186878, the contents of each of which are herein incorporated by reference in their entirety.

In one embodiment, the expressed antibodies may comprise peptides binding to senescent cell surface prion proteins, such as, but not limited to, those presented by SEQ ID NOs: 15-36 of International Publication No. WO2014186878, the contents of which are herein incorporated by reference in their entirety.

In one embodiment, the expressed antibody may be AMF-3a-118 or SMF 3d-19 (SEQ ID NO: 89-92 and 103-106 of International publication WO2014186878, respectively, the contents of which are herein incorporated by reference in their entirety) tanteting senescent cell surface protein FasR. In one embodiment, the expressed antibody may be Ab c-120 (SEQ ID NO: 37-40 of International publication WO2014186878, the contents of which are herein incorporated by reference in their entirety) targeting senescent cell surface protein PrP.

Payload Antibodies of the Invention

In one embodiment, the payload region of the AAV particle comprises one or more nucleic acid sequences encoding one or more of the payload antibody polypeptides listed in Tables 3-12.

In one embodiment, the payload region of the AAV particle comprises one or more nucleic acid sequences listed in Table 3-12.

In some embodiments, the payload region of the AAV particle comprises a nucleic acid sequence encoding a payload antibody with at least 50% identity to one or more payload antibody polypeptides listed in Tables 3-12. The encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload antibody polypeptides listed in Tables 3-12.

In one embodiment, the full sequence of the encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload antibody polypeptides listed in Tables 3-12.

In one embodiment, the variable region sequence(s) of the encoded antibody polypeptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload antibody polypeptides listed in Tables 3-12.

In one embodiment, the heavy chain of the encoded antibody polypeptide may have 50%, 51%, 52%, 54%, 55%, 56%, 57%, 58%, 59%, 60%, 61%, 62%, 63%, 64%, 65%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload heavy chain antibody polypeptides listed in Tables 3-12.

In one embodiment, the light chain of the encoded antibody polypeptide may have 50% 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more of the payload light chain antibody polypeptides listed in Tables 3-12.

In one embodiment, the CDR region of the encoded antibody holy peptide may have 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 80%, 81%, 82%, 83%, 84%, 85%, 86%, 87%, 88%, 89%, 90%, 91%, 92%, 93%, 94%, 95%, 96%, 97%, 98%, 99%, or 100% identity to the CDRs of one or more of the payload antibody polypeptides listed in Tables 3-12.

In one embodiment, the payload antibody has 90% identity to one or more of the antibody polypeptides listed in Tables 3-12.

In one embodiment, the payload antibody has 91% identity to one or more of the antibody polypeptides listed in Tables 3-12.

In one embodiment, the payload antibody has 92% identity to one or more of the antibody polypeptides listed in Tables 3-12.

In one embodiment, the payload antibody has 93% identity to one or more of the antibody polypeptides listed in Tables 3-12.

In one embodiment, the payload antibody has 94% identity to one or more of the antibody polypeptides listed in Tables 3-12.

In one embodiment, the payload antibody has 95% identity to one or more of the antibody polypeptides listed in Tables 3-12.

In one embodiment, the payload antibody has 96% identity to one or more of the antibody polypeptides listed in Tables 3-12.

In one embodiment, the payload antibody has 97% identity to one or more of the antibody polypeptides listed in Tables 3-12.

In one embodiment, the payload antibody has 98% identity to one or more of the antibody polypeptides listed in Tables 3-12.

In one embodiment, the payload antibody has 99% identity to one or more of the antibody polypeptides listed in Tables 3-12.

In one embodiment, the payload antibody has 100% identity to one or more of the antibody polypeptides listed in Tables 3-12.

In some embodiments, the payload region of the AAV particle comprises a nucleic acid sequence with at least 50% identity to one or more nucleic acid sequences listed in Tables 3-12. The payload nucleic acid sequence may have 50%, 51%, 52%, 53%, 54%, 55%, 50%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identity to one or more nucleic acid sequences listed in Tables 3-12.

In one embodiment, the payload nucleic acid sequence has 90% identity to one or more of the nucleic acid sequences listed in Tables 3-12.

In one embodiment, the payload nucleic acid sequence has 91% identity to one or more of the nucleic acid sequences listed in Tables 3-12.

In one embodiment, the payload nucleic acid sequence has 92% identity to one or more of the nucleic acid sequences listed in Tables 3-12.

In one embodiment, the payload nucleic acid sequence has 93% identity to one or more of the nucleic acid sequences listed in Tables 3-12.

In one embodiment, the payload nucleic acid sequence has 94% identity to one or more of the nucleic acid sequences listed in Tables 3-12.

In one embodiment, the payload nucleic acid sequence has 95% identity to one or more of the nucleic acid sequences listed in Tables 3-12.

In one embodiment, the payload nucleic acid sequence has 96% identity to one or more of the nucleic acid sequences listed in Tables 3-12.

In one embodiment, the payload nucleic acid sequence has 97% identity to one or more of the nucleic acid sequences listed in Tables 3-12.

In one embodiment, the payload nucleic acid sequence has 98% identity to one or more of the nucleic acid sequences listed in Tables 3-12.

In one embodiment, the payload nucleic acid sequence has 99% identity to one or more of the nucleic acid sequences listed in Tables 3-12.

In one embodiment, the payload nucleic acid sequence has 100% identity to one or more of the nucleic acid sequences listed in Tables 3-12.

Parkinson's Disease and Dementia with Lewy Bodies Antibodies

In one embodiment, the payload region of the AAV particle comprises one or more nucleic acid sequences encoding one or more of the Parkinson's Disease and dementia with Lewy Bodies payload antibody polypeptides listed in Table 3 (PDLB1-PDLB437; SEQ ID NO: 2948-3384).

TABLE 3

Parkinson's Disease and Dementia with Lewy Bodies Antibodies

| Antibody No. | Target | Description | Antibody Name | Reference Information | SEQ ID NO |
|---|---|---|---|---|---|
| PDLB1 | amyloid proteins | consensus sequence | M13 g3p, fd g3p, f1 g3p | US20150376239 SEQ ID NO: 4 | 2948 |
| PDLB2 | amyloid proteins | consensus sequence | I2-2 g3p, Ike g3p | US20150376239 SEQ ID NO: 7 | 2949 |
| PDLB3 | 118-126 of α-synuclein | constant region | IgG1 | US20150259404 SEQ ID NO: 38 | 2950 |
| PDLB4 | amyloid proteins | Fusion protein | M13 g3p | US20150376239 SEQ ID NO: 1 | 2951 |
| PDLB5 | amyloid proteins | Fusion protein | Construct 5 | US20150376239 SEQ ID NO: 11 | 2952 |
| PDLB6 | amyloid proteins | Fusion protein | Construct 6 | US20150376239 SEQ ID NO: 13 | 2953 |
| PDLB7 | amyloid proteins | Fusion protein | fd N2 | US20150376239 SEQ ID NO: 14 | 2954 |
| PDLB8 | amyloid proteins | Fusion protein | f1 N2 | US20150376239 SEQ ID NO: 15 | 2955 |
| PDLB9 | amyloid proteins | Fusion protein | M13 N2 | US20150376239 SEQ ID NO: 16 | 2956 |
| PDLB10 | amyloid proteins | Fusion protein | Ike N2 | US20150376239 SEQ ID NO: 17 | 2957 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB11 | amyloid proteins | Fusion protein | 12-2 N2 | US20150376239 SEQ ID NO: 18 | 2958 |
| PDLB12 | amyloid proteins | Fusion protein | If1 N2 | US20150376239 SEQ ID NO: 19 | 2959 |
| PDLB13 | amyloid proteins | Fusion protein | fd g3p | US20150376239 SEQ ID NO: 2 | 2960 |
| PDLB14 | amyloid proteins | Fusion protein | Construct 3 | US20150376239 SEQ ID NO: 20 | 2961 |
| PDLB15 | amyloid proteins | Fusion protein | Construct 3m g3p portion | US20150376239 SEQ ID NO: 24 | 2962 |
| PDLB16 | amyloid proteins | Fusion protein | If1 g3p | US20150376239 SEQ ID NO: 29 | 2963 |
| PDLB17 | amyloid proteins | Fusion protein | f1 g3p | US20150376239 SEQ ID NO: 3 | 2964 |
| PDLB18 | amyloid proteins | Fusion protein | fd g3p | US20150376239 SEQ ID NO: 30 | 2965 |
| PDLB19 | amyloid proteins | Fusion protein | Construct 8, rs-g3p (If1-N1N2)-hIgG1-Fc | US20150376239 SEQ ID NO: 31 | 2966 |
| PDLB20 | amyloid proteins | Fusion protein | I2-2 g3p | US20150376239 SEQ ID NO: 5 | 2967 |
| PDLB21 | amyloid proteins | Fusion protein | Ike g3p | US20150376239 SEQ ID NO: 6 | 2968 |
| PDLB22 | amyloid proteins | Fusion protein | If1 g3p | US20150376239 SEQ ID NO: 8 | 2969 |
| PDLB23 | amyloid proteins | Fusion protein | Construct 4 | US20150376239 SEQ ID NO: 9 | 2970 |
| PDLB24 | 118-126 of α-synuclein | Heavy chain | 5ClH1 | US20150259404 SEQ ID NO: 14 | 2971 |
| PDLB25 | 118-126 of α-synuclein | Heavy chain | 5ClH2 | US20150259404 SEQ ID NO: 15 | 2972 |
| PDLB26 | 118-126 of α-synuclein | Heavy chain | 5ClH3 | US20150259404 SEQ ID NO: 16 | 2973 |
| PDLB27 | 118-126 of α-synuclein | Heavy chain | 5ClH4 | US20150259404 SEQ ID NO: 17 | 2974 |
| PDLB28 | 118-126 of α-synuclein | Heavy chain | 5ClH5 | US20150259404 SEQ ID NO: 18 | 2975 |
| PDLB29 | 118-126 of α-synuclein | Heavy chain | 5Cl | US20150259404 SEQ ID NO: 6 | 2976 |
| PDLB30 | ACTH | Heavy chain | Ab7 | WO2015127288 SEQ ID NO: 241 | 2977 |
| PDLB31 | ACTH | Heavy chain | Ab9 | WO2015127288 SEQ ID NO: 281 | 2978 |
| PDLB32 | ACTH | Heavy chain | Ab10 | WO2015127288 SEQ ID NO: 321 | 2979 |
| PDLB33 | ACTH | Heavy chain | Ab11 | WO2015127288 SEQ ID NO: 361 | 2980 |
| PDLB34 | ACTH | Heavy chain | Ab12 | WO2015127288 SEQ ID NO: 401 | 2981 |
| PDLB35 | ACTH | Heavy chain | Ab2 | WO2015127288 SEQ ID NO: 41 | 2982 |
| PDLB36 | ACTH | Heavy chain | Ab1.H | WO2015127288 SEQ ID NO: 441 | 2983 |
| PDLB37 | ACTH | Heavy chain | Ab2.H | WO2015127288 SEQ ID NO: 481 | 2984 |
| PDLB38 | ACTH | Heavy chain | Ab3.H | WO2015127288 SEQ ID NO: 521 | 2985 |
| PDLB39 | ACTH | Heavy chain | Ab4.H | WO2015127288 SEQ ID NO: 561 | 2986 |
| PDLB40 | ACTH | Heavy chain | Ab6.H | WO2015127288 SEQ ID NO: 601 | 2987 |
| PDLB41 | ACTH | Heavy chain | Ab7.H | WO2015127288 SEQ ID NO: 641 | 2988 |
| PDLB42 | ACTH | Heavy chain | Ab7A.H | WO2015127288 SEQ ID NO: 681 | 2989 |
| PDLB43 | ACTH | Heavy chain | Ab10.H | WO2015127288 SEQ ID NO: 721 | 2990 |
| PDLB44 | ACTH | Heavy chain | Ab11.H | WO2015127288 SEQ ID NO: 761 | 2991 |
| PDLB45 | ACTH | Heavy chain | Ab11A.H | WO2015127288 SEQ ID NO: 801 | 2992 |
| PDLB46 | ACTH | Heavy chain | Ab3 | WO2015127288 SEQ ID NO: 81 | 2993 |
| PDLB47 | ACTH | Heavy chain | Ab12.H | WO2015127288 SEQ ID NO: 841 | 2994 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB48 | ACTH | Heavy chain | Ab4 | WO2015127288 SEQ ID NO: 121 | 2995 |
| PDLB49 | ACTH | Heavy chain | Ab5 | WO2015127288 SEQ ID NO: 161 | 2996 |
| PDLB50 | ACTH | Heavy chain | Ab6 | WO2015127288 SEQ ID NO: 201 | 2997 |
| PDLB51 | ACTH (Cushing's, PD, AD, anxiety disorders) | Heavy chain | Ab1 | WO2015127288 SEQ ID NO: 1 | 2998 |
| PDLB52 | alpha synuclein | Heavy chain | Hu1H7VHv1 | U.S. Pat. No. 8,790,644 SEQ ID NO: 19 | 2999 |
| PDLB53 | alpha synuclein | Heavy chain | Hu1H7VHv2 | U.S. Pat. No. 8,790,644 SEQ ID NO: 21 | 3000 |
| PDLB54 | alpha synuclein | Heavy chain | Hu1H7VHv3 | U.S. Pat. No. 8,790,644 SEQ ID NO: 23 | 3001 |
| PDLB55 | alpha synuclein | Heavy chain | Hu1H7VHv4 | U.S. Pat. No. 8,790,644 SEQ ID NO: 25 | 3002 |
| PDLB56 | alpha synuclein | Heavy chain | Hu1H7VHv5 | U.S. Pat. No. 8,790,644 SEQ ID NO: 27 | 3003 |
| PDLB57 | alpha synuclein | Heavy chain | Hu1H7VHv alternative | U.S. Pat. No. 8,790,644 SEQ ID NO: 44 | 3004 |
| PDLB58 | alpha synuclein | Heavy chain | Hu1H7VHv alternatives | U.S. Pat. No. 8,790,644 SEQ ID NO: 46 | 3005 |
| PDLB59 | alpha synuclein | Heavy chain | Humanized 5C 1H2 | WO2015075635 SEQ ID NO: 59 | 3006 |
| PDLB60 | alpha synuclein | Heavy chain | Humanized 5C 1H5 | WO2015075635 SEQ ID NO: 62 | 3007 |
| PDLB61 | alpha synuclein | Heavy chain | Hu1H7VH alternative | WO2015075635 SEQ ID NO: 121 | 3008 |
| PDLB62 | alpha synuclein | Heavy chain | Humanized 1 H7 heavy chain version 3 (variable region + constant region) | WO2015075635 SEQ ID NO: 126 | 3009 |
| PDLB63 | alpha synuclein | Heavy chain | Humanized 1H7 heavy chain version 3 (variable region + constant region G 1 m3 allotype) | WO2015075635 SEQ ID NO: 127 | 3010 |
| PDLB64 | alpha synuclein | Heavy chain | Hu9E4VH alternative | WO2015075635 SEQ ID NO: 29 | 3011 |
| PDLB65 | alpha synuclein | Heavy chain | Humanized 9E4 heavy chain version 3 (variable region + constant region) | WO2015075635 SEQ ID NO: 34 | 3012 |
| PDLB66 | alpha synuclein | Heavy chain | Humanized 9E4 heavy chain version 3 (variable region + constant region) | WO2015075635 SEQ ID NO: 36 | 3013 |
| PDLB67 | alpha synuclein | Heavy chain | Humanized 9E4 heavy chain version 3 (variable region + alternative constant region Glm3 allotype) | WO2015075635 SEQ ID NO: 37 | 3014 |
| PDLB68 | alpha synuclein | Heavy chain | Humanized 5C 1 H1 | WO2015075635 SEQ ID NO: 58 | 3015 |
| PDLB69 | alpha synuclein | Heavy chain | Humanized 5C 1H3 | WO2015075635 SEQ ID NO: 60 | 3016 |
| PDLB70 | alpha synuclein | Heavy chain | Humanized 5C 1H4 | WO2015075635 SEQ ID NO: 61 | 3017 |
| PDLB71 | amyloids | Heavy chain | #118 | WO2010012004 SEQ ID NO: 11 | 3018 |
| PDLB72 | amyloids | Heavy chain | #121 | WO2010012004 SEQ ID NO: 13 | 3019 |
| PDLB73 | amyloids | Heavy chain | #204 | WO2010012004 SEQ ID NO: 16 | 3020 |
| PDLB74 | amyloids | Heavy chain | 4205 | WO2010012004 SEQ ID NO: 18 | 3021 |
| PDLB75 | EAG1 | Heavy chain | chimeric ImAb3 | WO2006037604 SEQ ID NO: 12 | 3022 |
| PDLB76 | EAG1 | Heavy chain | chimeric ImAb4 | WO2006037604 SEQ ID NO: 16 | 3023 |
| PDLB77 | EAG1 | Heavy chain | HC-lmAb3-humVH3-72 | WO2006037604 SEQ ID NO: 20 | 3024 |
| PDLB78 | EAG1 | Heavy chain | HC-lmAb4-humVH4-59 | WO2006037604 SEQ ID NO: 24 | 3025 |
| PDLB79 | EAG1 | Heavy chain | HC-lmAb3-humVH3 23 | WO2006037604 SEQ ID NO: 28 | 3026 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB80 | EAG1 | Heavy chain | HC-lmAb3-humVH2 26 | WO2006037604 SEQ ID NO: 32 | 3027 |
| PDLB81 | EAG1 | Heavy chain | HC-lmAb4-humVH1-3 | WO2006037604 SEQ ID NO: 36 | 3028 |
| PDLB82 | EAG1 | Heavy chain | ImAb4 | WO2006037604 SEQ ID NO: 4 | 3029 |
| PDLB83 | EAG1 | Heavy chain | ImAb3 | WO2006037604 SEQ ID NO: 8 | 3030 |
| PDLB84 | NOGO | Heavy chain | H6L13 FL | US20140147435 SEQ ID NO: 27 | 3031 |
| PDLB85 | NOGO | Heavy chain | H16L16 FL, H16L18 FL | US20140147435 SEQ ID NO: 31 | 3032 |
| PDLB86 | NOGO | Heavy chain | H18L16 FL | US20140147435 SEQ ID NO: 33 | 3033 |
| PDLB87 | NOGO | Heavy chain | H19L13 FL, H19L16 FL, H19L18 FL | US20140147435 SEQ ID NO: 92 | 3034 |
| PDLB88 | NOGO | Heavy chain | H20L13 FL, H20L16 FL, H20L18 FL | US20140147435 SEQ ID NO: 93 | 3035 |
| PDLB89 | NOGO | Heavy chain | H21L13 FL, H21L16 FL, H21L18 FL | US20140147435 SEQ ID NO: 94 | 3036 |
| PDLB90 | NOGO | Heavy chain | H25L13 FL, H25L16 FL, H25L18 FL | US20140147435 SEQ ID NO: 98 | 3037 |
| PDLB91 | Nogo receptor-1 | Heavy chain | 5B10 | US20090215691 SEQ ID NO: 16 | 3038 |
| PDLB92 | Nogo receptor-1 | Heavy chain | 5B10 | US20090215691 SEQ ID NO: 18 | 3039 |
| PDLB93 | trk-C (NT-3 trkC ligand) | Heavy chain | 2250 | U.S. Pat. No. 7,615,383 SEQ ID NO: 42 | 3040 |
| PDLB94 | trk-C (NT-3 trkC ligand) | Heavy chain | 2253 | U.S. Pat. No. 7,615,383 SEQ ID NO: 43 | 3041 |
| PDLB95 | trk-C (NT-3 trkC ligand) | Heavy chain | 2256 | U.S. Pat. No. 7,615,383 SEQ ID NO: 44 | 3042 |
| PDLB96 | trk-C (NT-3 trkC ligand) | Heavy chain | 6.1.2 | U.S. Pat. No. 7,615,383 SEQ ID NO: 45 | 3043 |
| PDLB97 | trk-C (NT-3 trkC ligand) | Heavy chain | 6.4.1 | U.S. Pat. No. 7,615,383 SEQ ID NO: 46 | 3044 |
| PDLB98 | trk-C (NT-3 trkC ligand) | Heavy chain | 2345 | U.S. Pat. No. 7,615,383 SEQ ID NO: 47 | 3045 |
| PDLB99 | trk-C (NT-3 trkC ligand) | Heavy chain | 2349 | U.S. Pat. No. 7,615,383 SEQ ID NO: 48 | 3046 |
| PDLB100 | alpha synuclein | Heavy chain consensus chain | Hu9E4VH consensus amino acid sequence | U.S. Pat. No. 8,609,820 SEQ ID NO: 27 | 3047 |
| PDLB101 | alpha synuclein | Heavy chain consensus chain | m9E4VH | WO2015075635 SEQ ID NO: 6 | 3048 |
| PDLB102 | alpha synuclein | Heavy chain constant region | Humanized 1H7 heavy chain constant region (IgG2) | WO2015075635 SEQ ID NO: 128 | 3049 |
| PDLB103 | alpha synuclein | Heavy chain constant region | Humanized 1H7 heavy chain constant region (G1m1 allotype) | WO2015075635 SEQ ID NO: 129 | 3050 |
| PDLB104 | alpha synuclein | Heavy chain constant region | Humanized 9E4 heavy chain constant region (G1m3 allotype: BIP version) | WO2015075635 SEQ ID NO: 35 | 3051 |
| PDLB105 | alpha synuclein | Heavy chain constant region (G1m1 allotype) | Hu1H7 | U.S. Pat. No. 8,790,644 SEQ ID NO: 58 | 3052 |
| PDLB106 | alpha syrinclein | Heavy chain constant region G1m3 allotype) | Hu1H7 | U.S. Pat. No. 8,790,644 SEQ ID NO: 52 | 3053 |
| PDLB107 | alpha synuclein | Heavy chain constant region (IgG1; common for v1-v5) | Hu1H7 | U.S. Pat. No. 8,790,644 SEQ ID NO: 50 | 3054 |
| PDLB108 | alpha synuclein | Heavy chain constant region (IgG2) | Hu1H7 | U.S. Pat. No. 8,790,644 SEQ ID NO: 57 | 3055 |
| PDLB109 | many - growth factors (to increase transport across BBB) | Heavy chain fusion protein | H19L13, H19L16, H19L18, H19L14, H19L15, H19L17, H19L6, H19L11 | U.S. Pat. No. 8,053,569 SEQ ID NO: 25 | 3056 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB110 | many - growth factors (to increase transport across BBB) | Heavy chain fusion protein | H20L13, H20L16, H20L18, H20L14, H20L15, H20L17, H2016, H20L11 | U.S. Pat. No. 8,053,569 SEQ ID NO: 28 | 3057 |
| PDLB111 | many - growth factors (to increase transport across BBB) | Heavy chain fusion protein | H22L13, H22L16, H22L18, H22L14, H22L15, H22L17, H22L6, H22L11 | U.S. Pat. No. 8,053,569 SEQ ID NO: 34 | 3058 |
| PDLB112 | many - growth factors (to increase transport across BRB) | Heavy chain fusion protein | H5L11, H6L11, H14L11, H15L11, H16L11, H17L11, H18L11, H19L11, H20L11, H21L11, H22L11, H23L11, H24L11, H25L11, H700L11 | U.S. Pat. No. 8,053,569 SEQ ID NO: 24 | 3059 |
| PDLB113 | NOGO | Heavy chain humanized construct H1 | 2A10 construct | WO2007003421 SEQ ID NO: 79 | 3060 |
| PDLB114 | NOGO | Heavy chain humanized construct H14 | 2A10 construct | WO2007003421 SEQ ID NO: 29 | 3061 |
| PDLB115 | NOGO | Heavy chain humanized construct H15 | 2A10 construct | WO2007003421 SEQ ID NO: 30 | 3062 |
| PDLB116 | NOGO | Heavy chain humanized construct H16 | 2A10 construct | WO2007003421 SEQ ID NO: 31 | 3063 |
| PDLB117 | NOGO | Heavy chain humanized construct H17 | 2A10 construct | WO2007003421 SEQ ID NO: 32 | 3064 |
| PDLB118 | NOGO | Heavy chain humanized construct H18 | 2A10 construct | WO2007003421 SEQ ID NO: 33 | 3065 |
| PDLB119 | NOGO | Heavy chain humanized construct H19 | 2A10 construct | WO2007003421 SEQ ID NO: 92 | 3066 |
| PDLB120 | NOGO | Heavy chain humanized construct H20 | 2A10 construct | WO2007003421 SEQ ID NO: 93 | 3067 |
| PDLB121 | NOGO | Heavy chain humanized construct H21 | 2A10 construct | WO2007003421 SEQ ID NO: 94 | 3068 |
| PDLB122 | NOGO | Heavy chain humanized construct H22 | 2A10 construct | WO2007003421 SEQ ID NO: 95 | 3069 |
| PDLB123 | NOGO | Heavy chain humanized construct H23 | 2A10 construct | WO2007003421 SEQ ID NO: 96 | 3070 |
| PDLB124 | NOGO | Heavy chain humanized construct H24 | 2A10 construct | WO2007003421 SEQ ID NO: 97 | 3071 |
| PDLB125 | NOGO | Heavy chain humanized construct H25 | 2A10 construct | WO2007003421 SEQ ID NO: 98 | 3072 |
| PDLB126 | NOGO | Heavy chain humanized construct H5 | 2A10 construct | WO2007003421 SEQ ID NO: 26 | 3073 |
| PDLB127 | NOGO | Heavy chain humanized construct H6 | 2A10 construct | WO2007003421 SEQ ID NO: 27 | 3074 |
| PDLB128 | NOGO | Heavy chain humanized construct H700 | 2A10 construct | WO2007003421 SEQ ID NO: 28 | 3075 |
| PDLB129 | RTN4 (NOGO) | Heavy chain IgG4, immunomodulator | Atinumab | U.S. Pat. No. 8,163,285 SEQ ID NO: 24 | 3076 |
| PDLB130 | alpha synuclein | Heavy chain variable region | NI-202.12F4-VHA1b-GL | US20150232542 SEQ ID NO: 10 | 3077 |
| PDLB131 | alpha synuclein | Heavy chain variable region | NI-202.3D8-VHE1 | US20150232542 SEQ ID NO: 15 | 3078 |
| PDLB132 | alpha synuclein | Heavy chain variable region | NI-202.3D8-VHE1-GL | US20150232542 SEQ ID NO: 16 | 3079 |
| PDLB133 | alpha synuclein | Heavy chain variable region | NI-202.3G12-VHB1 | US20150232542 SEQ ID NO: 3 | 3080 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB134 | alpha synuclein | Heavy chain variable region | NI-202.3G12-VHB1-GL | US20150232542 SEQ ID NO: 4 | 3081 |
| PDLB135 | alpha synuclein | Heavy chain variable region | NI-202.12F4-VHA1b | US20150232542 SEQ ID NO: 9 | 3082 |
| PDLB136 | alpha synuclein | Heavy chain variable region | Hu9E4VHv3 variable region | U.S. Pat. No. 8,609,820 SEQ ID NO: 10 | 3083 |
| PDLB137 | alpha synuclein | Heavy chain variable region | Hu9E4VHv4 variable region | U.S. Pat. No. 8,609,820 SEQ ID NO: 11 | 3084 |
| PDLB138 | alpha synuclein | Heavy chain variable region | Hu9E4VLv3 variable region | U.S. Pat. No. 8,609,820 SEQ ID NO: 5 | 3085 |
| PDLB139 | alpha synuclein | Heavy chain variable region | m9E4VH variable region | U.S. Pat. No. 8,609,820 SEQ ID NO: 6 | 3086 |
| PDLB140 | alpha synuclein | Heavy chain variable region | I791009Hu9E4VHFr variable region | U.S. Pat. No. 8,609,820 SEQ ID NO: 7 | 3087 |
| PDLB141 | alpha synuclein | Heavy chain variable region | Hu9E4VHv1 variable region | U.S. Pat. No. 8,609,820 SEQ ID NO: 8 | 3088 |
| PDLB142 | alpha synuclein | Heavy chain variable region | Hu9E4VHv2 variable region | U.S. Pat. No. 8,609,820 SEQ ID NO: 9 | 3089 |
| PDLB143 | alpha synuclein | Heavy chain variable region | m1H7 | U.S. Pat. No. 8,790,644 SEQ ID NO: 5 | 3090 |
| PDLB144 | alpha synuclein | Heavy chain variable region | mature m1H7 | U.S. Pat. No. 8,790,644 SEQ ID NO: 9 | 3091 |
| PDLB145 | alpha synuclein | Heavy chain variable region | Hu9E4VHv 3 | WO2015075635 SEQ ID NO: 10 | 3092 |
| PDLB146 | alpha synuclein | Heavy chain variable region | HulH7VHv4 | WO2015075635 SEQ ID NO: 101 | 3093 |
| PDLB147 | alpha synuclein | Heavy chain variable region | Hu9E4VHv4 (no back mutation) | WO2015075635 SEQ ID NO: 11 | 3094 |
| PDLB148 | alpha synuclein | Heavy chain variable region | HulH7VHv5 | WO2015075635 SEQ ID NO: 103 | 3095 |
| PDLB149 | alpha synuclein | Heavy chain variable region | 63 102889Hu9E4VLFr | WO2015075635 SEQ ID NO: 2 | 3096 |
| PDLB150 | alpha synuclein | Heavy chain variable region | m5C1 antibody heavy chain variable region amino acid sequence | WO2015075635 SEQ ID NO: 39 | 3097 |
| PDLB151 | alpha synuclein | Heavy chain variable region | i 791009Hu9E4VHFr | WO2015075635 SEQ ID NO: 7 | 3098 |
| PDLB152 | alpha synuclein | Heavy chain variable region | Hu9E4VHv 1 | WO2015075635 SEQ ID NO: 8 | 3099 |
| PDLB153 | alpha synuclein | Heavy chain variable region | mlH7 | WO2015075635 SEQ ID NO: 81 | 3100 |
| PDLB154 | alpha synuclein | Heavy chain variable region | mature mlH7 | WO2015075635 SEQ ID NO: 85 | 3101 |
| PDLB155 | alpha synuclein | Heavy chain variable region | Hu9E4VHv2 | WO2015075635 SEQ ID NO: 9 | 3102 |
| PDLB156 | alpha synuclein | Heavy chain variable region | Hu lH7VHv1 | WO2015075635 SEQ ID NO: 95 | 3103 |
| PDLB157 | alpha synuclein | Heavy chain variable region | HulH7VHv2 | WO2015075635 SEQ ID NO: 97 | 3104 |
| PDLB158 | alpha synuclein | Heavy chain variable region | HulH7VHv3 | WO2015075635 SEQ ID NO: 99 | 3105 |
| PDLB159 | alpha synuclein protofibrils | Heavy chain variable region | BA1: 49/G | WO2011104696 SEQ ID NO: 56 | 3106 |
| PDLB160 | alpha synuclein protofibrils | Heavy chain variable region | BA1: 49/G | WO2011104696 SEQ ID NO: 57 | 3107 |
| PDLB161 | alpha synuclein protofibrils | Heavy chain variable region | BA2: 38E2/7 | WO2011104696 SEQ ID NO: 58 | 3108 |
| PDLB162 | alpha synuclein protofibrils | Heavy chain variable region | BA2: 38E2/7 | WO2011104696 SEQ ID NO: 59 | 3109 |
| PDLB163 | amyloid oligomers | Heavy chain variable region | F11G3 | U.S. Pat. No. 9,125,846 SEQ ID NO: 11 | 3110 |
| PDLB164 | DR6 and P75 | Heavy chain variable region | M66-B03 | WO2010062904 SEQ ID NO: 67 | 3111 |
| PDLB165 | DR6 and P75 | Heavy chain variable region | M50-H01 | WO2010062904 SEQ ID NO: 7 | 3112 |
| PDLB166 | DR6 and P75 | Heavy chain variable region | M67-G02 | WO2010062904 SEQ ID NO: 77 | 3113 |
| PDLB167 | DR6 and P75 | Heavy chain variable region | M72-F03 | WO2010062904 SEQ ID NO: 87 | 3114 |
| PDLB168 | DR6 and P75 | Heavy chain variable region | M73-C04 | WO2010062904 SEQ ID NO: 97 | 3115 |
| PDLB169 | DR6 and P75 | Heavy chain variable region | 1P1D6.3 | WO2010062904 SEQ ID NO: 107 | 3116 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB170 | DR6 and P75 | Heavy chain variable region | 1P2F2.1 | WO2010062904 SEQ ID NO: 117 | 3117 |
| PDLB171 | DR6 and P75 | Heavy chain variable region | 1P5D10.2 | WO2010062904 SEQ ID NO: 127 | 3118 |
| PDLB172 | DR6 and P75 | Heavy chain variable region | M51-H09 | WO2010062904 SEQ ID NO: 17 | 3119 |
| PDLB173 | DR6 and P75 | Heavy chain variable region | M53-E04 | WO2010062904 SEQ ID NO: 27 | 3120 |
| PDLB174 | DR6 and P75 | Heavy chain variable region | M53-F04 | WO2010062904 SEQ ID NO: 37 | 3121 |
| PDLB175 | DR6 and P75 | Heavy chain variable region | M62-B02 | WO2010062904 SEQ ID NO: 47 | 3122 |
| PDLB176 | DR6 and P75 | Heavy chain variable region | M63-E10 | WO2010062904 SEQ ID NO: 57 | 3123 |
| PDLB177 | LPG (lysophosphatidyl glucoside) | Heavy chain variable region | #7 | U.S. Pat. No. 8,591,902 SEQ ID NO: 18 | 3124 |
| PDLB178 | LPG (lysophosphatidyl glucoside) | Heavy chain variable region | #15 | U.S. Pat. No. 8,591,902 SEQ ID NO: 8 | 3125 |
| PDLB179 | MAG | Heavy chain variable region | | U.S. Pat. No. 8,071,731 SEQ ID NO: 13 | 3126 |
| PDLB180 | MAG | Heavy chain variable region | | U.S. Pat. No. 8,071,731 SEQ ID NO: 14 | 3127 |
| PDLB181 | MAG | Heavy chain variable region | | U.S. Pat. No. 8,071,731 SEQ ID NO: 15 | 3128 |
| PDLB182 | MAI (myelin associated inhibitor) | Heavy chain variable region | | WO2013158748 SEQ ID NO: 1 | 3129 |
| PDLB183 | MAI (myelin associated inhibitor) | Heavy chain variable region | | WO2013158748 SEQ ID NO: 17 | 3130 |
| PDLB184 | NMDA | Heavy chain variable region | | EP2805972 SEQ ID NO: 43 | 3131 |
| PDLB185 | NOGO | Heavy chain variable region | H5L13, H5L16, H5L18, H5L14, H5L15, H5L17, H5L6, H5L11 | US20140147435 SEQ ID NO: 11 | 3132 |
| PDLB186 | NOGO | Heavy chain variable region | H6L13, H6L16, H6L18, H6L14, H6L15, H6L17, H6L6 | US20140147435 SEQ ID NO: 12 | 3133 |
| PDLB187 | NOGO | Heavy chain variable region | H700L13, H700L16, H700L18, H700L14, H700L15, H700L17, H700L6, H700L11 | US20140147435 SEQ ID NO: 13 | 3134 |
| PDLB188 | NOGO | Heavy chain variable region | H14L13, H14L16, H14L18, H14L14, H14L15, H14L17, H14L6, H14L11 | US20140147435 SEQ ID NO: 14 | 3135 |
| PDLB189 | NOGO | Heavy chain variable region | H15L13, H15L16, H15L18, H15L14, H15L15, H15L17, H15L6, H15L11 | US20140147435 SEQ ID NO: 15 | 3136 |
| PDLB190 | NOGO | Heavy chain variable region | H16L13, H16L16, H16L18, H16L14, H16L15, H16L17, H16L6, H16L11 | US20140147435 SEQ ID NO: 16 | 3137 |
| PDLB191 | NOGO | Heavy chain variable region | H17L13, H17L16, H17L18, H17L14, H17L15, H17L17, H17L6, H17L11 | US20140147435 SEQ ID NO: 17 | 3138 |
| PDLB192 | NOGO | Heavy chain variable region | H18L13, H18L16, H18L18, H18L14, H18L15, H18L17, H18L6, H18L11 | US20140147435 SEQ ID NO: 18 | 3139 |
| PDLB193 | NOGO | Heavy chain variable region | H1L13, H1L16, H1L18, H1L14, H1L15, H1L17, H1L6 | US20140147435 SEQ ID NO: 77 | 3140 |
| PDLB194 | NOGO | Heavy chain variable region | H19L13, H19L16, H19L18, H19L4, H19L15, H19L17, H19L6, H19L11 | US20140147435 SEQ ID NO: 85 | 3141 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB195 | NOGO | Heavy chain variable region | H20L13, H20L16, H20L18, H20L14, H20L15, H20L17, H20L6, H20L11 | US20140147435 SEQ ID NO: 86 | 3142 |
| PDLB196 | NOGO | Heavy chain variable region | H21L13, H21L16, H21L18, H21L14, H21L15, H21L17, H21L6, H21L11 | US20140147435 SEQ ID NO: 87 | 3143 |
| PDLB197 | NOGO | Heavy chain variable region | H22L13, H22L16, H22L18, H22L14, H22L15, H22L17, H22L6, H22L11 | US20140147435 SEQ ID NO: 88 | 3144 |
| PDLB198 | NOGO | Heavy chain variable region | H23L13, H23L16, H23L18, H23L14, H23L15, H23L17, H23L6, H23L11 | US20140147435 SEQ ID NO: 89 | 3145 |
| PDLB199 | NOGO | Heavy chain variable region | H24L13, H24L16, H24L18, H24L14, H24L15, H24L17, H24L6, H24L11 | US20140147435 SEQ ID NO: 90 | 3146 |
| PDLB200 | NOGO | Heavy chain variable region | H25L13, H25L16, H25L18, H25L14, H25L15, H25L17, H25L6, H25L11 | US20140147435 SEQ ID NO: 91 | 3147 |
| PDLB201 | Nogo-66 | Heavy chain variable region | Antibody clone 50 | US20140065155 SEQ ID NO: 3 | 3148 |
| PDLB202 | Nogo-66 | Heavy chain variable region | Antibody clone 51 | US20140065155 SEQ ID NO: 5 | 3149 |
| PDLB203 | NogoA/NiG | Heavy chain variable region | 6A3-Ig4 | WO2009056509 SEQ ID NO: 24 | 3150 |
| PDLB204 | NogoA/NiG | Heavy chain variable region | 6A3-IgG1 | WO2009056509 SEQ ID NO: 4 | 3151 |
| PDLB205 | RGM A | Heavy chain variable region | 5F9.1-GL | US20150183871 SEQ ID NO: 35 | 3152 |
| PDLB206 | RGM A | Heavy chain variable region | 5F9.2-GL | US20150183871 SEQ ID NO: 36 | 3153 |
| PDLB207 | RGM A | Heavy chain variable region | 5F9.3-GL | US20150183871 SEQ ID NO: 37 | 3154 |
| PDLB208 | RGM A | Heavy chain variable region | 5F9.4-GL | US20150183871 SEQ ID NO: 38 | 3155 |
| PDLB209 | RGM A | Heavy chain variable region | 5F9.5-GL | US20150183871 SEQ ID NO: 39 | 3156 |
| PDLB210 | RGM A | Heavy chain variable region | 5F9.6-GL | US20150183871 SEQ ID NO: 40 | 3157 |
| PDLB211 | RGM A | Heavy chain variable region | 5F9.7-GL | US20150183871 SEQ ID NO: 41 | 3158 |
| PDLB212 | RGM A | Heavy chain variable region | 5F9.8-GL | US20150183871 SEQ ID NO: 42 | 3159 |
| PDLB213 | RGM A | Heavy chain variable region | 5F9.9-GL | US20150183871 SEQ ID NO: 43 | 3160 |
| PDLB214 | RGM A | Heavy chain variable region | h5F9.1, h5F9.1, h5F9.1, h5F9.1, h5F9.1, h5F9.2, h5F9.3 | US20150183871 SEQ ID NO: 47 | 3161 |
| PDLB215 | RGM A | Heavy chain variable region | h5F9.3, h5F9.9, h5F9.25 | US20150183871 SEQ ID NO: 53 | 3162 |
| PDLB216 | RGM A | Heavy chain variable region | h5F9.4, h5F9.10, h5F9.26 | US20150183871 SEQ ID NO: 54 | 3163 |
| PDLB217 | RGMa | Heavy chain variable region | AE12-1 | US20140023659 SEQ ID NO: 1 | 3164 |
| PDLB218 | RGMa | Heavy chain variable region | AE12-20 | US20140023659 SEQ ID NO: 107 | 3165 |
| PDLB219 | RGMa | Heavy chain variable region | AE12-21 | US20140023659 SEQ ID NO: 115 | 3166 |
| PDLB220 | RGMa | Heavy chain variable region | AE12-23 | US20140023659 SEQ ID NO: 123 | 3167 |
| PDLB221 | RGMa | Heavy chain variable region | AE12-24 | US20140023659 SEQ ID NO: 131 | 3168 |
| PDLB222 | RGMa | Heavy chain variable region | AE12-3 | US20140023659 SEQ ID NO: 17 | 3169 |
| PDLB223 | RGMa | Heavy chain variable region | AE12-4 | US20140023659 SEQ ID NO: 25 | 3170 |
| PDLB224 | RGMa | Heavy chain variable region | AE12-5 | US20140023659 SEQ ID NO: 33 | 3171 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB225 | RGMa | Heavy chain variable region | AE12-6 | US20140023659 SEQ ID NO: 41 | 3172 |
| PDLB226 | RGMa | Heavy chain variable region | AE12-7 | US20140023659 SEQ ID NO: 49 | 3173 |
| PDLB227 | RGMa | Heavy chain variable region | AE12-8 | US20140023659 SEQ ID NO: 57 | 3174 |
| PDLB228 | RGMa | Heavy chain variable region | AE12-2 | US20140023659 SEQ ID NO: 9 | 3175 |
| PDLB229 | RGMa | Heavy chain variable region | AE12-13 | US20140023659 SEQ ID NO: 91 | 3176 |
| PDLB230 | RGMa | Heavy chain variable region | AE12-15 | US20140023659 SEQ ID NO: 99 | 3177 |
| PDLB231 | α-synuclein aggregates | Heavy chain variable region | Syn-O1 | WO2014132210 SEQ ID NO: 10 | 3178 |
| PDLB232 | α-synuclein aggregates | Heavy chain variable region | Syn-F1 | WO2014132210 SEQ ID NO: 2 | 3179 |
| PDLB233 | α-synuclein aggregates | Heavy chain variable region | Syn-F2 | WO2014132210 SEQ ID NO: 6 | 3180 |
| PDLB234 | NOGO | Heavy chain variable region humanized construct H1 | 2A10 construct | WO2007003421 SEQ ID NO: 77 | 3181 |
| PDLB235 | NOGO | Heavy chain variable region humanized construct H14 | 2A10 construct | WO2007003421 SEQ ID NO: 14 | 3182 |
| PDLB236 | NOGO | Heavy chain variable region humanized construct H15 | 2A10 construct | WO2007003421 SEQ ID NO: 15 | 3183 |
| PDLB237 | NOGO | Heavy chain variable region humanized construct H16 | 2A10 construct | WO2007003421 SEQ ID NO: 16 | 3184 |
| PDLB238 | NOGO | Heavy chain variable region humanized construct H17 | 2A10 construct | WO2007003421 SEQ ID NO: 17 | 3185 |
| PDLB239 | NOGO | Heavy chain variable region humanized construct H18 | 2A10 construct | WO2007003421 SEQ ID NO: 18 | 3186 |
| PDLB240 | NOGO | Heavy chain variable region humanized construct H19 | 2A10 construct | WO2007003421 SEQ ID NO: 85 | 3187 |
| PDLB241 | NOGO | Heavy chain variable region humanized construct H20 | 2A10 construct | WO2007003421 SEQ ID NO: 86 | 3188 |
| PDLB242 | NOGO | Heavy chain variable region humanized construct H21 | 2A10 construct | WO2007003421 SEQ ID NO: 87 | 3189 |
| PDLB243 | NOGO | Heavy chain variable region humanized construct H22 | 2A10 construct | WO2007003421 SEQ ID NO: 88 | 3190 |
| PDLB244 | NOGO | Heavy chain variable region humanized construct H23 | 2A10 construct | WO2007003421 SEQ ID NO: 89 | 3191 |
| PDLB245 | NOGO | Heavy chain variable region humanized construct H24 | 2A10 construct | WO2007003421 SEQ ID NO: 90 | 3192 |
| PDLB246 | NOGO | Heavy chain variable region humanized construct H25 | 2A10 construct | WO2007003421 SEQ ID NO: 91 | 3193 |
| PDLB247 | NOGO | Heavy chain variable region humanized construct H5 | 2A10 construct | WO2007003421 SEQ ID NO: 11 | 3194 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB248 | NOGO | Heavy chain variable region humanized construct H6 | 2A10 construct | WO2007003421 SEQ ID NO: 12 | 3195 |
| PDLB249 | NOGO | Heavy chain variable region humanized construct H700 | 2A10 construct | WO2007003421 SEQ ID NO: 13 | 3196 |
| PDLB250 | alpha synuclein | Heavy chain version 3 (variable region + constant region) | Hu1H7 | U.S. Pat. No. 8,790,644 SEQ ID NO: 55 | 3197 |
| PDLB251 | alpha synuclein | Heavy chain version 3 (variable region + constant region; G1m3 allotype) | Hu1H7 | U.S. Pat. No. 8,790,644 SEQ ID NO: 56 | 3198 |
| PDLB252 | 118-126 of α-synuclein | Light chain | 5CIL1 | US20150259404 SEQ ID NO: 29 | 3199 |
| PDLB253 | 118-126 of α-synuclein | Light chain | 5CIL2 | US20150259404 SEQ ID NO: 30 | 3200 |
| PDLB254 | 118-126 of α-synuclein | Light chain | 5CIL3 | US20150259404 SEQ ID NO: 31 | 3201 |
| PDLB255 | 118-126 of α-synuclein | Light chain | 5CIL4 | US20150259404 SEQ ID NO: 32 | 3202 |
| PDLB256 | 118-126 of α-synuclein | Light chain | IgG1 | US20150259404 SEQ ID NO: 40 | 3203 |
| PDLB257 | 118-126 of α-synuclein | Light chain | 5Cl | US20150259404 SEQ ID NO: 8 | 3204 |
| PDLB258 | ACTH | Light chain | Ab3 | WO2015127288 SEQ ID NO: 101 | 3205 |
| PDLB259 | ACTH | Light chain | Ab4 | WO2015127288 SEQ ID NO: 141 | 3206 |
| PDLB260 | ACTH | Light chain | Ab5 | WO2015127288 SEQ ID NO: 181 | 3207 |
| PDLB261 | ACTH | Light chain | Ab1 | WO2015127288 SEQ ID NO: 21 | 3208 |
| PDLB262 | ACTH | Light chain | Ab6 | WO2015127288 SEQ ID NO: 221 | 3209 |
| PDLB263 | ACTH | Light chain | Ab7 | WO2015127288 SEQ ID NO: 261 | 3210 |
| PDLB264 | ACTH | Light chain | Ab9 | WO2015127288 SEQ ID NO: 301 | 3211 |
| PDLB265 | ACTH | Light chain | Ab10 | WO2015127288 SEQ ID NO: 341 | 3212 |
| PDLB266 | ACTH | Light chain | Ab11 | WO2015127288 SEQ ID NO: 381 | 3213 |
| PDLB267 | ACTH | Light chain | Ab12 | WO2015127288 SEQ ID NO: 421 | 3214 |
| PDLB268 | ACTH | Light chain | Ab1.H | WO2015127288 SEQ ID NO: 461 | 3215 |
| PDLB269 | ACTH | Light chain | Ab2.H | WO2015127288 SEQ ID NO: 501 | 3216 |
| PDLB270 | ACTH | Light chain | Ab3.H | WO2015127288 SEQ ID NO: 541 | 3217 |
| PDLB271 | ACTH | Light chain | Ab4.H | WO2015127288 SEQ ID NO: 581 | 3218 |
| PDLB272 | ACTH | Light chain | Ab2 | WO2015127288 SEQ ID NO: 61 | 3219 |
| PDLB273 | ACTH | Light chain | Ab6.H | WO2015127288 SEQ ID NO: 621 | 3220 |
| PDLB274 | ACTH | Light chain | Ab7.H | WO2015127288 SEQ ID NO: 661 | 3221 |
| PDLB275 | ACTH | Light chain | Ab7A.H | WO2015127288 SEQ ID NO: 701 | 3222 |
| PDLB276 | ACTH | Light chain | Ab10.H | WO2015127288 SEQ ID NO: 741 | 3223 |
| PDLB277 | ACTH | Light chain | Ab11.H | WO2015127288 SEQ ID NO: 781 | 3224 |
| PDLB278 | ACTH | Light chain | Ab11A.H | WO2015127288 SEQ ID NO: 821 | 3225 |
| PDLB279 | ACTH | Light chain | Ab12.H | WO2015127288 SEQ ID NO: 861 | 3226 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB280 | alpha synuclein | Light chain | Hu1H7VLv1 | U.S. Pat. No. 8,790,644 SEQ ID NO: 33 | 3227 |
| PDLB281 | alpha synuclein | Light chain | Hu1H7VLv2 | U.S. Pat. No. 8,790,644 SEQ ID NO: 35 | 3228 |
| PDLB282 | alpha synuclein | Light chain | Hu1H7VLv3 | U.S. Pat. No. 8,790,644 SEQ ID NO: 37 | 3229 |
| PDLB283 | alpha synuclein | Light chain | Hu1H7VLv4 | U.S. Pat. No. 8,790,644 SEQ ID NO: 39 | 3230 |
| PDLB284 | alpha synuclein | Light chain | Hu1H7VL alternative | U.S. Pat. No. 8,790,644 SEQ ID NO: 45 | 3231 |
| PDLB285 | alpha synuclein | Light chain | sequence for Hu1H7VL alternatives | U.S. Pat. No. 8,790,644 SEQ ID NO: 47 | 3232 |
| PDLB286 | alpha synuclein | Light chain | humanized 5C 1L1 | WO2015075635 SEQ ID NO: 69 | 3233 |
| PDLB287 | alpha synuclein | Light chain | humanized 5C 1L2 | WO2015075635 SEQ ID NO: 70 | 3234 |
| PDLB288 | alpha synuclein | Light chain | Hu1H7VL alternative | WO2015075635 SEQ ID NO: 122 | 3235 |
| PDLB289 | alpha synuclein | Light chain | humanized 1H7 light chain version 3 (variable region + constant region with Arginine) | WO2015075635 SEQ ID NO: 124 | 3236 |
| PDLB290 | alpha synuclein | Light chain | humanized 1H7 light chain version 3 (variable region + constant region without Arginine) | WO2015075635 SEQ ID NO: 125 | 3237 |
| PDLB291 | alpha synuclein | Light chain | Hu9E4VL alternative | WO2015075635 SEQ ID NO: 28 | 3238 |
| PDLB292 | alpha synuclein | Light chain | humanized 9E4 light chain version 3 (variable region + constant region with Arginine) | WO2015075635 SEQ ID NO: 32 | 3239 |
| PDLB293 | alpha synuclein | Light chain | humanized 9E4 light chain version 3 (variable region + constant region without Arginine) | WO2015075635 SEQ ID NO: 33 | 3240 |
| PDLB294 | alpha synuclein | Light chain | humanized 5C L3 | WO2015075635 SEQ ID NO: 71 | 3241 |
| PDLB295 | amyloids | Light chain | #118 | WO2010012004 SEQ ID NO: 10 | 3242 |
| PDLB296 | amyloids | Light chain | #121 | WO2010012004 SEQ ID NO: 12 | 3243 |
| PDLB297 | amyloids | Light chain | #201 | WO2010012004 SEQ ID NO: 14 | 3244 |
| PDLB298 | amyloids | Light chain | #204 | WO2010012004 SEQ ID NO: 15 | 3245 |
| PDLB299 | amyloids | Light chain | #205 | WO2010012004 SEQ ID NO: 17 | 3246 |
| PDLB300 | EAG1 | Light chain | chimeric ImAb3 | WO2006037604 SEQ ID NO: 10 | 3247 |
| PDLB301 | EAG1 | Light chain | chimeric ImAb4 | WO2006037604 SEQ ID NO: 14 | 3248 |
| PDLB302 | EAG1 | Light chain | LC-lmAb3-humB3 | WO2006037604 SEQ ID NO: 18 | 3249 |
| PDLB303 | EAG1 | Light chain | ImAb4 | WO2006037604 SEQ ID NO: 2 | 3250 |
| PDLB304 | EAG1 | Light chain | LC-lmAb4-humA17 | WO2006037604 SEQ ID NO: 22 | 3251 |
| PDLB305 | EAG1 | Light chain | LC-lmAb3-humA3 | WO2006037604 SEQ ID NO: 26 | 3252 |
| PDLB306 | EAG1 | Light chain | LC-lmAb3-humA17 | WO2006037604 SEQ ID NO: 30 | 3253 |
| PDLB307 | EAG1 | Light chain | LC-lmAb4-humA5-1 | WO2006037604 SEQ ID NO: 34 | 3254 |
| PDLB308 | EAG1 | Light chain | LC-lmAh4-humO1 | WO2006037604 SEQ ID NO: 38 | 3255 |
| PDLB309 | EAG1 | Light chain | ImAb3 | WO2006037604 SEQ ID NO: 6 | 3256 |
| PDLB310 | NOGO | Light chain | H6L13 FL, H19L13 FL, H20L13 FL, H21L13 FL, H25L13 FL | US20140147435 SEQ ID NO: 35 | 3257 |
| PDLB311 | NOGO | Light chain | H16L16 FL, H19L16 FL, H20L16 FL, H21L16 FL, H25L16 FL, H18L16 FL | US20140147435 SEQ ID NO: 38 | 3258 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB312 | NOGO | Light chain | H16L18 FL, H19L18 FL, H20L18 FL, H21L18 FL, H25L18 FL | US20140147435 SEQ ID NO: 40 | 3259 |
| PDLB313 | Nogo receptor-1 | Light chain | 7E11 | US20090215691 SEQ ID NO: 15 | 3260 |
| PDLB314 | Nogo receptor-1 | Light chain | 7E11 | US20090215691 SEQ ID NO: 17 | 3261 |
| PDLB315 | trk-C (NT-3 trkC ligand) | Light chain | 2250 | U.S. Pat. No. 7,615,383 SEQ ID NO: 49 | 3262 |
| PDLB316 | trk-C (NT-3 trkC ligand) | Light chain | 2253 | U.S. Pat. No. 7,615,383 SEQ ID NO: 50 | 3263 |
| PDLB317 | trk-C (NT-3 trkC ligand) | Light chain | 2256 | U.S. Pat. No. 7,615,383 SEQ ID NO: 51 | 3264 |
| PDLB318 | trk-C (NT-3 trkC ligand) | Light chain | 6.1.2 | U.S. Pat. No. 7,615,383 SEQ ID NO: 52 | 3265 |
| PDLB319 | trk-C (NT-3 trkC ligand) | Light chain | 6.4.1 | U.S. Pat. No. 7,615,383 SEQ ID NO: 53 | 3266 |
| PDLB320 | trk-C (NT-3 trkC ligand) | Light chain | 2345 | U.S. Pat. No. 7,615,383 SEQ ID NO: 54 | 3267 |
| PDLB321 | trk-C (NT-3 trkC ligand) | Light chain | 2349 | U.S. Pat. No. 7,615,383 SEQ ID NO: 55 | 3268 |
| PDLB322 | alpha synuclein | Light chain consensus chain | Hu9E4VL consensus amino acid sequence | U.S. Pat. No. 8,609,820 SEQ ID NO: 26 | 3269 |
| PDLB323 | alpha synuclein | Light chain constant region | humanized 9E4 light chain constant region | U.S. Pat. No. 8,609,820 SEQ ID NO: 13 | 3270 |
| PDLB324 | alpha synuclein | Light chain constant region | humanized 9E4 heavy chain constant region | U.S. Pat. No. 8,609,820 SEQ ID NO: 14 | 3271 |
| PDLB325 | alpha synuclein | Light chain constant region | humanized 9E4 | WO2015075635 SEQ ID NO: 13 | 3272 |
| PDLB326 | alpha synuclein | Light chain constant region (with arginine) (common for v1-v4) | Hu1H7 | U.S. Pat. No. 8,790,644 SEQ ID NO: 49 | 3273 |
| PDLB327 | alpha synuclein | Light chain constant region (without arginine) (common for v1-v4) | Hu1H7 | U.S. Pat. No. 8,790,644 SEQ ID NO: 51 | 3274 |
| PDLB328 | many - growth factors (to increase transport across BBB) | Light chain fusion protein | H21L13, H21L16, H21L18, H21L14, H21L15, H21L17, H21L6, H21L11 | U.S. Pat. No. 8,053,569 SEQ ID NO: 31 | 3275 |
| PDLB329 | many - growth factors (to increase transport across BBB) | Light chain fusion protein | H23L13, H23L16, H23L18, H23L14, H23L15, H23L17, H23L6, H23L11 | U.S. Pat. No. 8,053,569 SEQ ID NO: 36 | 3276 |
| PDLB330 | NOGO | Light chain humanized construct L11 | 2A10 construct | WO2007003421 SEQ ID NO: 80 | 3277 |
| PDLB331 | NOGO | Light chain humanized construct L13 | 2A10 construct | WO2007003421 SEQ ID NO: 35 | 3278 |
| PDLB332 | NOGO | Light chain humanized construct L14 | 2A10 construct | WO2007003421 SEQ ID NO: 36 | 3279 |
| PDLB333 | NOGO | Light chain humanized construct L15 | 2A10 construct | WO2007003421 SEQ ID NO: 37 | 3280 |
| PDLB334 | NOGO | Light chain humanized construct L16 | 2A10 construct | WO2007003421 SEQ ID NO: 38 | 3281 |
| PDLB335 | NOGO | Light chain humanized construct L17 | 2A10 construct | WO2007003421 SEQ ID NO: 39 | 3282 |
| PDLB336 | NOGO | Light chain humanized construct L18 | 2A10 construct | WO2007003421 SEQ ID NO: 40 | 3283 |
| PDLB337 | NOGO | Light chain humanized construct L6 | 2A10 construct | WO2007003421 SEQ ID NO: 34 | 3284 |
| PDLB338 | RTN4 | Light chain IgG4, immunomodulator | Atinumab | U.S. Pat. No. 8,163,285 SEQ ID NO: 25 | 3285 |
| PDLB339 | alpha synuclein | Light chain variable region | NI-202.12F4-VLa1 | US20150232542 SEQ ID NO: 12 | 3286 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB340 | alpha synuclein | Light chain variable region | NI-202.12F4-VLa1-GL | US20150232542 SEQ ID NO: 13 | 3287 |
| PDLB341 | alpha synuclein | Light chain variable region | NI-202.3D8-VKa1 | US20150232542 SEQ ID NO: 18 | 3288 |
| PDLB342 | alpha synuclein | Light chain variable region | NI-202.3D8-VKa1-GL | US20150232542 SEQ ID NO: 19 | 3289 |
| PDLB343 | alpha synuclein | Light chain variable region | NI-202.3D8-VKc1 | US20150232542 SEQ ID NO: 21 | 3290 |
| PDLB344 | alpha synuclein | Light chain variable region | NI-202.3D8-VKc1-GL | US20150232542 SEQ ID NO: 22 | 3291 |
| PDLB345 | alpha synuclein | Light chain variable region | NI-202.3G12-VLc1 | US20150232542 SEQ ID NO: 6 | 3292 |
| PDLB346 | alpha synuclein | Light chain variable region | NI-202.3G12-VLc1-GL | US20150232542 SEQ ID NO: 7 | 3293 |
| PDLB347 | alpha synuclein | Light chain variable region | m9E4VL variable region | U.S. Pat. No. 8,609,820 SEQ ID NO: 1 | 3294 |
| PDLB348 | alpha synuclein | Light chain variable region | 63102889Hu9E4VLFr region variable | U.S. Pat. No. 8,609,820 SEQ ID NO: 2 | 3295 |
| PDLB349 | alpha synuclein | Light chain variable region | Hu9E4VLv1 variable region | U.S. Pat. No. 8,609,820 SEQ ID NO: 3 | 3296 |
| PDLB350 | alpha synuclein | Light chain variable region | Hu9E4VLv2 variable region | U.S. Pat. No. 8,609,820 SEQ ID NO: 4 | 3297 |
| PDLB351 | alpha synuclein | Light chain variable region | mature m1H7 light chain variable | U.S. Pat. No. 8,790,644 SEQ ID NO: 11 | 3298 |
| PDLB352 | alpha synuclein | Light chain variable region | m1H7 light chain variable | U.S. Pat. No. 8,790,644 SEQ ID NO: 7 | 3299 |
| PDLB353 | alpha synuclein | Light chain variable region | m9E4VL | WO2015075635 SEQ ID NO: 1 | 3300 |
| PDLB354 | alpha synuclein | Light chain variable region | Hu1H7VLv2 | WO2015075635 SEQ ID NO: 111 | 3301 |
| PDLB355 | alpha synuclein | Light chain variable region | Hu1H7VLv3 | WO2015075635 SEQ ID NO: 113 | 3302 |
| PDLB356 | alpha synuclein | Light chain variable region | Hu1H7VLv1 | WO2015075635 SEQ ID NO: 109 | 3303 |
| PDLB357 | alpha synuclein | Light chain variable region | Hu1H7VLv4 | WO2015075635 SEQ ID NO: 115 | 3304 |
| PDLB358 | alpha synuclein | Light chain variable region | Hu9E4VLv1 | WO2015075635 SEQ ID NO: 3 | 3305 |
| PDLB359 | alpha synuclein | Light chain variable region | Hu9E4VLv2 (No back mutation) | WO2015075635 SEQ ID NO: 4 | 3306 |
| PDLB360 | alpha synuclein | Light chain variable region | m5C 1 antibody light chain variable region amino acid sequence | WO2015075635 SEQ ID NO: 43 | 3307 |
| PDLB361 | alpha synuclein | Light chain variable region | Hu9E4VLv3 | WO2015075635 SEQ ID NO: 5 | 3308 |
| PDLB362 | alpha synuclein | Light chain variable region | mlH7 | WO2015075635 SEQ ID NO: 83 | 3309 |
| PDLB363 | alpha synuclein | Light chain variable region | mature mlH7 | WO2015075635 SEQ ID NO: 87 | 3310 |
| PDLB364 | alpha synuclein protofibrils | Light chain variable region | BA3: 38F11/2_8 | WO2011104696 SEQ ID NO: 60 | 3311 |
| PDLB365 | alpha synuclein protofibrils | Light chain variable region | BA3: 38F11/2_8 | WO2011104696 SEQ ID NO: 61 | 3312 |
| PDLB366 | alpha synuclein protofibrils | Light chain variable region | BA4: 48B11/8 | WO2011104696 SEQ ID NO: 62 | 3313 |
| PDLB367 | alpha synuclein protofibrils | Light chain variable region | BA4: 48B11/8 | WO2011104696 SEQ ID NO: 63 | 3314 |
| PDLB368 | amyloid oligomers | Light chain variable region | F11G3 | U.S. Pat. No. 9,125,846 SEQ ID NO: 12 | 3315 |
| PDLB369 | DR6 and P75 | Light chain variable region | M73-C04 | WO2010062904 SEQ ID NO: 102 | 3316 |
| PDLB370 | DR6 and P75 | Light chain variable region | 1P1D6.3 | WO2010062904 SEQ ID NO: 112 | 3317 |
| PDLB371 | DR6 and P75 | Light chain variable region | M50-H02 | WO2010062904 SEQ ID NO: 12 | 3318 |
| PDLB372 | DR6 and P75 | Light chain variable region | 1P2F2.1 | WO2010062904 SEQ ID NO: 122 | 3319 |
| PDLB373 | DR6 and P75 | Light chain variable region | 1P5D10.2 | WO2010062904 SEQ ID NO: 132 | 3320 |
| PDLB374 | DR6 and P75 | Light chain variable region | M51-H09 | WO2010062904 SEQ ID NO: 22 | 3321 |
| PDLB375 | DR6 and P75 | Light chain variable region | M53-E04 | WO2010062904 SEQ ID NO: 32 | 3322 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB376 | DR6 and P75 | Light chain variable region | M53-F04 | WO2010062904 SEQ ID NO: 42 | 3323 |
| PDLB377 | DR6 and P75 | Light chain variable region | M62-B02 | WO2010062904 SEQ ID NO: 52 | 3324 |
| PDLB378 | DR6 and P75 | Light chain variable region | M63-E10 | WO2010062904 SEQ ID NO: 62 | 3325 |
| PDLB379 | DR6 and P75 | Light chain variable region | M66-B03 | WO2010062904 SEQ ID NO: 72 | 3326 |
| PDLB380 | DR6 and P75 | Light chain variable region | M67-G02 | WO2010062904 SEQ ID NO: 82 | 3327 |
| PDLB381 | DR6 and P75 | Light chain variable region | M72-F03 | WO2010062904 SEQ ID NO: 92 | 3328 |
| PDLB382 | LPG (lysophosphatidyl glucoside) | Light chain variable region | #7 | U.S. Pat. No. 8,591,902 SEQ ID NO: 17 | 3329 |
| PDLB383 | LPG (lysophosphatidyl glucoside) | Light chain variable region | #15 | U.S. Pat. No. 8,591,902 SEQ ID NO: 7 | 3330 |
| PDLB384 | MAG | Light chain variable region | | U.S. Pat. No. 8,071,731 SEQ ID NO: 16 | 3331 |
| PDLB385 | MAG | Light chain variable region | | U.S. Pat. No. 8,071,731 SEQ ID NO: 17 | 3332 |
| PDLB386 | MAG | Light chain variable region | | U.S. Pat. No. 8,071,731 SEQ ID NO: 18 | 3333 |
| PDLB387 | MAG | Light chain variable region | | U.S. Pat. No. 8,071,731 SEQ ID NO: 19 | 3334 |
| PDLB388 | MAI (myelin associated inhibitor) | Light chain variable region | | WO2013158748 SEQ ID NO: 11 | 3335 |
| PDLB389 | MAI (myelin associated inhibitor) | Light chain variable region | | WO2013158748 SEQ ID NO: 27 | 3336 |
| PDLB390 | NMDA | Light chain variable region | | EP2805972 SEQ ID NO: 44 | 3337 |
| PDLB391 | NOGO | Light chain variable region | H1L6, H5L6, H6L6, H14L6, H15L6, H16L6, H17L6, H18L6, H19L6, H20L6, H21L6, H22L6, H23L6, H24L6, H25L6, H700L6 | US20140147435 SEQ ID NO: 19 | 3338 |
| PDLB392 | NOGO | Light chain variable region | H1L13, H5L13, H6L13, H14L13, H15L13, H16L13, H17L13, H18L13, H19L13, H20L13, H21L13, H22L13, H23L13, H24L13, H25L13, H700L13 | US20140147435 SEQ ID NO: 20 | 3339 |
| PDLB393 | NOGO | Light chain variable region | H1L14, H5L14, H6L14, H14L14, H15L14, H16L14, H17L14, H18L14, H19L14, H20L14, H21L14, H22L14, H23L14, H24L14, H25L14, H700L14 | US20140147435 SEQ ID NO: 21 | 3340 |
| PDLB394 | NOGO | Light chain variable region | H1L15, H5L15, H6L15, H14L15, H15L15, H16L15, H17L15, H18L15, H19L15, H20L15, H21L15, H22L15, H23L15, H24L15, H25L15, H700L15 | US20140147435 SEQ ID NO: 22 | 3341 |
| PDLB395 | NOGO | Light chain variable region | H1L16, H5L16, H6L16, H14L16, H15L16, H16L16, H17L16, H18L16, H19L16, H20L16, H21L16, H22L16, H23L16, H24L16, H25L16, H700L16 | US20140147435 SEQ ID NO: 23 | 3342 |
| PDLB396 | NOGO | Light chain variable region | H1L17, H5L17, H6L17, H14L17, H15L17, | US20140147435 SEQ ID NO: 24 | 3343 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| | | | H16L17, H17L17, H18L17, H19L17, H20L17, H21L17, H22L17, H23L17, H24L17, H25L17, H700L17 | | |
| PDLB397 | NOGO | Light chain variable region | H1L18, H5L18, H6L18, H14L18, H15L18, H16L18, H17L18, H18L18, H19L18, H20L18, H21L18, H22L18, H23L18, H24L18, H25L18, H700L18 | US20140147435 SEQ ID NO: 25 | 3344 |
| PDLB398 | NOGO | Light chain variable region | H5L11, H6L11, H14L11, H15L11, H16L11, H17L11, H18L11, H19L11, H20L11, H21L11, H22L11, H23L11, H24L11, H25L11, H700L11 | US20140147435 SEQ ID NO: 78 | 3345 |
| PDLB399 | Nogo-66 | Light chain variable region | Antibody clone 50 | US20140065155 SEQ ID NO: 4 | 3346 |
| PDLB400 | Nogo-66 | Light chain variable region | Antibody clone 51 | US20140065155 SEQ ID NO: 6 | 3347 |
| PDLB401 | NogoA/NiG | Light chain variable region | 6A3-Ig4 | WO2009056509 SEQ ID NO: 25 | 3348 |
| PDLB402 | NogoA/NiG | Light chain variable region | 6A3-IgG1 | WO2009056509 SEQ ID NO: 5 | 3349 |
| PDLB403 | RGM A | Light chain variable region | 5F9.1-GL, 5F9.1-GL, 5F9.1-GL, 5F9.1-GL, 5F9.1-GL, 5F9.1-GL, 5F9.1-GL, 5F9.1-GL, h5F9.4, h5F9.11, h5F9.12 | US20150183871 SEQ ID NO: 44 | 3350 |
| PDLB404 | RGM A | Light chain variable region | 5F9.2-GL, 5F9.2-GL, 5F9.2-GL, 5F9.2-GL, 5F9.2-GL, 5F9.2-GL, 5F9.2-GL, 5F9.2-GL, h5F9.5, h5F9.19, h5F9.20 | US20150183871 SEQ ID NO: 45 | 3351 |
| PDLB405 | RGM A | Light chain variable region | 5F9.3-GL, 5F9.3-GL, 5F9.3-GL, 5F9.3-GL, 5F9.3-GL, 5F9.3-GL, 5F9.3-GL, 5F9.3-GL, h5F9.6, h5F9.21, h5F9.22 | US20150183871 SEQ ID NO: 46 | 3352 |
| PDLB406 | RGM A | Light chain variable region | h5F9.5, h5F9.6, h5F9.7, h5F9.8, h5F9.9, h5F9.10 | US20150183871 SEQ ID NO: 48 | 3353 |
| PDLB407 | RGM A | Light chain variable region | h5F9.11, h5F9.19, h5F9.21 | US20150183871 SEQ ID NO: 49 | 3354 |
| PDLB408 | RGM A | Light chain variable region | h5F9.12, h5F9.20, h5F9.22, h5F9.23, h5F9.25, h5F9.25, h5F9.26 | US20150183871 SEQ ID NO: 50 | 3355 |
| PDLB409 | RGM A | Light chain variable region | h5F9.1, h5F9.7, h5F9.23 | US20150183871, SEQ ID NO: 51 | 3356 |
| PDLB410 | RGM A | Light chain variable region | h5F9.2, h5F9.8, h5F9.25 | US20150183871 SEQ ID NO: 52 | 3357 |
| PDLB411 | RGMa | Light chain variable region | AE12-15 | US20140023659 SEQ ID NO: 103 | 3358 |
| PDLB412 | RGMa | Light chain variable region | AE12-20 | US20140023659 SEQ ID NO: 111 | 3359 |
| PDLB413 | RGMa | Light chain variable region | AE12-21 | US20140023659 SEQ ID NO: 119 | 3360 |
| PDLB414 | RGMa | Light chain variable region | AE12-23 | US20140023659 SEQ ID NO: 127 | 3361 |
| PDLB415 | RGMa | Light chain variable region | AE12-2 | US20140023659 SEQ ID NO: 13 | 3362 |
| PDLB416 | RGMa | Light chain variable region | AE12-24 | US20140023659 SEQ ID NO: 135 | 3363 |
| PDLB417 | RGMa | Light chain variable region | AE12-3 | US20140023659 SEQ ID NO: 21 | 3364 |
| PDLB418 | RGMa | Light chain variable region | AE12-4 | US20140023659 SEQ ID NO: 29 | 3365 |

TABLE 3-continued

Parkinson's Disease and Dementia with Lewy Bodies Antibodies

| Antibody No. | Target | Description | Antibody Name | Reference Information | SEQ ID NO |
|---|---|---|---|---|---|
| PDLB419 | RGMa | Light chain variable region | AE12-5 | US20140023659 SEQ ID NO: 37 | 3366 |
| PDLB420 | RGMa | Light chain variable region | AE12-6 | US20140023659 SEQ ID NO: 45 | 3367 |
| PDLB421 | RGMa | Light chain variable region | AE12-1 | US20140023659 SEQ ID NO: 5 | 3368 |
| PDLB422 | RGMa | Light chain variable region | AE12-7 | US20140023659 SEQ ID NO: 53 | 3369 |
| PDLB423 | RGMa | Light chain variable region | AE12-8 | US20140023659 SEQ ID NO: 61 | 3370 |
| PDLB424 | RGMa | Light chain variable region | AE12-13 | US20140023659 SEQ ID NO: 95 | 3371 |
| PDLB425 | α-synuclein aggregates | Light chain variable region | Syn-01 | WO2014132210 SEQ ID NO: 12 | 3372 |
| PDLB426 | α-synuclein aggregates | Light chain variable region | Syn-F1 | WO2014132210 SEQ ID NO: 4 | 3373 |
| PDLB427 | α-synuclein aggregates | Light chain variable region | Syn-F2 | WO2014132210 SEQ ID NO: 8 | 3374 |
| PDLB428 | NOGO | Light chain variable region humanized construct L11 | 2A10 construct | WO2007003421 SEQ ID NO: 78 | 3375 |
| PDLB429 | NOGO | Light chain variable region humanized construct L13 | 2A10 construct | WO2007003421 SEQ ID NO: 20 | 3376 |
| PDLB430 | NOGO | Light chain variable region humanized construct L14 | 2A10 construct | WO2007003421 SEQ ID NO: 21 | 3377 |
| PDLB431 | NOGO | Light chain variable region humanized construct L15 | 2A10 construct | WO2007003421 SEQ ID NO: 22 | 3378 |
| PDLB432 | NOGO | Light chain variable region humanized construct L16 | 2A10 construct | WO2007003421 SEQ ID NO: 23 | 3379 |
| PDLB433 | NOGO | Light chain variable region humanized construct L17 | 2A10 construct | WO2007003421 SEQ ID NO: 24 | 3380 |
| PDLB434 | NOGO | Light chain variable region humanized construct L18 | 2A10 construct | WO2007003421 SEQ ID NO: 25 | 3381 |
| PDLB435 | NOGO | Light chain variable region humanized construct L16 | 2A10 construct | WO2007003421 SEQ ID NO: 19 | 3382 |
| PDLB436 | alpha synuclein | Light chain version 3 (variable region + constant region with arginine) | Hu1H7 | U.S. Pat. No. 8,790,644 SEQ ID NO: 53 | 3383 |
| PDLB437 | alpha synuclein | Light chain version 3 (variable region + constant region without arginine) | Hu1H7 | U.S. Pat. No. 8,790,644 SEQ ID NO: 54 | 3384 |

In one embodiment, the payload region of the AAV particle comprises one or more nucleic acid sequences encoding one or more of the polypeptides that comprise a portion of filamentous bacteriophage gene 3 protein (g3p) sufficient to bind to and/or disaggregate amyloid described in International Publication No. WO2014193935, the contents of which are herein incorporated by reference in their entirety. As a non-limiting example, the payload region of the AAV particle comprises one or more nucleic acid sequences encoding one or more of the polypeptides described in WO2014193935 may be used to treat, prevent and/or reduce the effects of Parkinson's Disease and/or dementia. As another non-limiting example, the payload region of the AAV particle comprises one or more nucleic acid sequences encoding one or more of the polypeptides described in WO2014193935 may be used to treat, prevent and/or reduce the effects of Alzheimer's Disease. As another non-limiting example, the payload region of the AAV particle comprises one or more nucleic acid sequences encoding one or more of the polypeptides described in WO2014193935 may be used to treat, prevent and/or reduce the effects of Huntington's Disease. As another non-limiting example, the payload region of the AAV particle comprises one or more nucleic acid sequences encoding one or more of the poly peptides described in WO2014193935 may be used to treat, prevent and/or reduce the effects of muscle disease such as, but not limited to, Multiple System Atrophy (MSA), Amyotrophic Lateral Sclerosis (ALS) and Duchenne Muscular Dystrophy (DMD).

Alzheimer's Disease Antibodies

In one embodiment, the payload region of the AAV particle comprises one or more nucleic acid sequences encoding one or more of the Alzheimer's Disease payload antibody polypeptides listed in Table 4 (AD1-AD1178; SEQ ID NO: 2948-2970, 2977-2998, 3018-3046, 3056-3076, 3110-3177, 3181-3196, 3205-3226, 3242-3268, 3275-3285, 3315-3371, 3375-3382, 3385-4258).

TABLE 4

| | | | Alzheimer's Disease Antibodies | | |
|---|---|---|---|---|---|
| Antibody No. | Target | Description | Antibody Name | Reference Information | SEQ ID NO |
| AD1 | amyloid proteins | consensus sequence | M13 g3p, fd g3p, ft g3p | US20150376239 SEQ ID NO: 4 | 2948 |
| AD2 | amyloid proteins | consensus sequence | 12-2 g3p, Ike g3p | US20150376239 SEQ ID NO: 7 | 2949 |
| AD3 | Aβ amyloid | Consensus sequence for kappa chain | | WO2006066049 SEQ ID NO: 14 | 3385 |
| AD4 | Aβ amyloid | Consensus sequence for kappa chain | | WO2006066049 SEQ ID NO: 15 | 3386 |
| AD5 | Aβ amyloid | Consensus sequence for kappa chain | | WO2006066049 SEQ ID NO: 16 | 3387 |
| AD6 | Aβ amyloid | Consensus sequence for kappa chain | | WO2006066049 SEQ ID NO: 17 | 3388 |
| AD7 | Aβ amyloid | Consensus sequence for lambda chain | | WO2006066049 SEQ ID NO: 18 | 3389 |
| AD8 | Aβ amyloid | Consensus sequence for lambda chain | | WO2006066049 SEQ ID NO: 19 | 3390 |
| AD9 | Aβ amyloid | Consensus sequence for lambda chain | | WO2006066049 SEQ ID NO: 20 | 3391 |
| AD10 | 118-126 of α-synuclein | constant region | IgG1 | US20150259404 SEQ ID NO: 38 | 2950 |
| AD11 | beta A4 peptide/Alpha beta 5 | Fc region | Antibody A | WO2007068429 SEQ ID NO: 6 | 3392 |
| AD12 | amyloid proteins | Fusion protein | M13 g3p | US20150376239 SEQ ID NO: 1 | 2951 |
| AD13 | amyloid proteins | Fusion protein | Construct 5 | US20150376239 SEQ ID NO: 11 | 2952 |
| AD14 | amyloid proteins | Fusion protein | Construct 6 | US20150376239 SEQ ID NO: 13 | 2953 |
| AD15 | amyloid proteins | Fusion protein | fd N2 | US20150376239 SEQ ID NO: 14 | 2954 |
| AD16 | amyloid proteins | Fusion protein | f1 N2 | US20150376239 SEQ ID NO: 15 | 2955 |
| AD17 | amyloid proteins | Fusion protein | M13 N2 | US20150376239 SEQ ID NO: 16 | 2956 |
| AD18 | amyloid proteins | Fusion protein | Ike N2 | US20150376239 SEQ ID NO: 17 | 2957 |
| AD19 | amyloid proteins | Fusion protein | 12-2 N2 | US20150376239 SEQ ID NO: 18 | 2958 |
| AD20 | amyloid proteins | Fusion protein | If1 N2 | US20150376239 SEQ ID NO: 19 | 2959 |
| AD21 | amyloid proteins | Fusion protein | fd g3p | US20150376239 SEQ ID NO: 2 | 2960 |
| AD22 | amyloid proteins | Fusion protein | Construct 3 | US20150376239 SEQ ID NO: 20 | 2961 |
| AD23 | amyloid proteins | Fusion protein | Construct 3m g3p portion | US20150376239 SEQ ID NO: 24 | 2962 |
| AD24 | amyloid proteins | Fusion protein | If1 g3p | US20150376239 SEQ ID NO: 29 | 2963 |
| AD25 | amyloid proteins | Fusion protein | f1 g3p | US20150376239 SEQ ID NO: 3 | 2964 |
| AD26 | amyloid proteins | Fusion protein | fd g3p | US20150376239 SEQ ID NO: 30 | 2965 |
| AD27 | amyloid proteins | Fusion protein | Construct 8, rs-g3p (If1-N1N2)-hIgG1-Fc | US20150376239 SEQ ID NO: 31 | 2966 |
| AD28 | amyloid proteins | Fusion protein | I2-2 g3p | US20150376239 SEQ ID NO: 5 | 2967 |
| AD29 | amyloid proteins | Fusion protein | Ike g3p | US20150376239 SEQ ID NO: 6 | 2968 |
| AD30 | amyloid proteins | Fusion protein | If1 g3p | US20150376239 SEQ ID NO: 8 | 2969 |

TABLE 4-continued

Alzheimer's Disease Antibodies

| Antibody No. | Target | Description | Antibody Name | Reference Information | SEQ ID NO |
|---|---|---|---|---|---|
| AD31 | amyloid proteins | Fusion protein | Construct 4 | US20150376239 SEQ ID NO: 9 | 2970 |
| AD32 | ACTH | Heavy chain | Ab4 | WO2015127288 SEQ ID NO: 121 | 2995 |
| AD33 | ACTH | Heavy chain | Ab5 | WO2015127288 SEQ ID NO: 161 | 2996 |
| AD34 | ACTH | Heavy chain | Ab6 | WO2015127288 SEQ ID NO: 201 | 2997 |
| AD35 | ACTH | Heavy chain | Ab7 | WO2015127288 SEQ ID NO: 241 | 2977 |
| AD36 | ACTH | Heavy chain | Ab9 | WO2015127288 SEQ ID NO: 281 | 2978 |
| AD37 | ACTH | Heavy chain | Ab10 | WO2015127288 SEQ ID NO: 321 | 2979 |
| AD38 | ACTH | Heavy chain | Ab11 | WO2015127288 SEQ ID NO: 361 | 2980 |
| AD39 | ACTH | Heavy chain | Ab12 | WO2015127288 SEQ ID NO: 401 | 2981 |
| AD40 | ACTH | Heavy chain | Ab2 | WO2015127288 SEQ ID NO: 41 | 2982 |
| AD41 | ACTH | Heavy chain | Ab1.H | WO2015127288 SEQ ID NO: 441 | 2983 |
| AD42 | ACTH | Heavy chain | Ab2.H | WO2015127288 SEQ ID NO: 481 | 2984 |
| AD43 | ACTH | Heavy chain | Ab3.H | WO2015127288 SEQ ID NO: 521 | 2985 |
| AD44 | ACTH | Heavy chain | Ab4.H | WO2015127288 SEQ ID NO: 561 | 2986 |
| AD45 | ACTH | Heavy chain | Ab6.H | WO2015127288 SEQ ID NO: 601 | 2987 |
| AD46 | ACTH | Heavy chain | Ab7.H | WO2015127288 SEQ ID NO: 641 | 2988 |
| AD47 | ACTH | Heavy chain | Ab7A.H | WO2015127288 SEQ ID NO: 681 | 2989 |
| AD48 | ACTH | Heavy chain | Ab10.H | WO2015127288 SEQ ID NO: 721 | 2990 |
| AD49 | ACTH | Heavy chain | Ab11.H | WO2015127288 SEQ ID NO: 761 | 2991 |
| AD50 | ACTH | Heavy chain | Ab11A.H | WO2015127288 SEQ ID NO: 801 | 2992 |
| AD51 | ACTH | Heavy chain | Ab3 | WO2015127288 SEQ ID NO: 81 | 2993 |
| AD52 | ACTH | Heavy chain | Ab12.H | WO2015127288 SEQ ID NO: 841 | 2994 |
| AD53 | ACTH | Heavy chain | Ab1 | WO2015127288 SEQ ID NO: 1 | 2998 |
| AD54 | Alpha beta fibril | Heavy chain | Gantenerumab | Immunogenetics Information System; CHAIN ID NO: 8894_H. | 3393 |
| AD55 | amyloid beta peptide Aβ | Heavy chain | | U.S. Pat. No. 719,576 SEQ ID NO: 12 | 3394 |
| AD56 | Amyloid beta/BACE1 | Heavy chain | 2 Fab of Yw412.8.31 | Wang, W. et al "A Therapeutic Antibody Targeting BACE1 Inhibits Amyloid. NO:-{beta}Production in Vivo" Sci Transl Med 3 (84), 84RA43 (2011), NCBI Accession # 3RIG_H (222aa) | 3395 |
| AD57 | amyloid or amyloid-like proteins | Heavy chain | Humanized C2 | WO2008061796 SEQ ID NO: 4 | 3396 |
| AD58 | amyloid protein | Heavy chain | C2 | US20100150906 SEQ ID NO: 16 | 3397 |
| AD59 | amyloids | Heavy chain | #118 | WO2010012004 SEQ ID NO: 11 | 3018 |
| AD60 | amyloids | Heavy chain | #121 | WO2010012004 SEQ ID NO: 13 | 3019 |
| AD61 | amyloids | Heavy chain | #204 | WO2010012004 SEQ ID NO: 16 | 3020 |

TABLE 4-continued

Alzheimer's Disease Antibodies

| Antibody No. | Target | Description | Antibody Name | Reference Information | SEQ ID NO |
|---|---|---|---|---|---|
| AD62 | amyloids | Heavy chain | #205 | WO2010012004 SEQ ID NO: 18 | 3021 |
| AD63 | APP | Heavy chain | F5.100 | WO2014151747 SEQ ID NO: 2 | 3398 |
| AD64 | APP | Heavy chain | BBS1 MAb | WO2014151747 SEQ ID NO: 24 | 3399 |
| AD65 | APP | Heavy chain | F5.87 | WO2014151747 SEQ ID NO: 26 | 3400 |
| AD66 | APP | Heavy chain | F5.87 | WO2014151747 SEQ ID NO: 52 | 3401 |
| AD67 | Aβ amyloids | Heavy chain | Humanized 12A11, version 3 | U.S. Pat. No. 8,784,810 SEQ ID NO: 11 | 3402 |
| AD68 | Aβ amyloids | Heavy chain | Humanized 12A11, version 4.1 | U.S. Pat. No. 8,784,810 SEQ ID NO: 12 | 3403 |
| AD69 | Aβ amyloids | Heavy chain | Humanized 12A11, version 4.2 | U.S. Pat. No. 8,784,810 SEQ ID NO: 13 | 3404 |
| AD70 | Aβ amyloids | Heavy chain | Humanized 12A11, version 4.3 | U.S. Pat. No. 8,784,810 SEQ ID NO: 14 | 3405 |
| AD71 | Aβ amyloids | Heavy chain | Humanized 12A11, version 4.4 | U.S. Pat. No. 8,784,810 SEQ ID NO: 15 | 3406 |
| AD72 | Aβ amyloids | Heavy chain | Humanized 12A11, version 5.1 | U.S. Pat. No. 8,784,810 SEQ ID NO: 16 | 3407 |
| AD73 | Aβ amyloids | Heavy chain | Humanized 12A11, version 5.2 | U.S. Pat. No. 8,784,810 SEQ ID NO: 17 | 3408 |
| AD74 | Aβ amyloids | Heavy chain | Humanized 12A11, version 5.3 | U.S. Pat. No. 8,784,810 SEQ ID NO: 18 | 3409 |
| AD75 | Aβ amyloids | Heavy chain | Humanized 12A11, version 5.4 | U.S. Pat. No. 8,784,810 SEQ ID NO: 19 | 3410 |
| AD76 | Aβ amyloids | Heavy chain | Humanized 12A11, version 5.5 | U.S. Pat. No. 8,784,810 SEQ ID NO: 20 | 3411 |
| AD77 | Aβ amyloids | Heavy chain | Humanized 12A11, version 5.6 | U.S. Pat. No. 8,784,810 SEQ ID NO: 21 | 3412 |
| AD78 | Aβ amyloids | Heavy chain | Humanized 12A11, version 6.1 | U.S. Pat. No. 8,784,810 SEQ ID NO: 22 | 3413 |
| AD79 | Aβ amyloids | Heavy chain | Humanized 12A11, version 6.2 | U.S. Pat. No. 8,784,810 SEQ ID NO: 23 | 3414 |
| AD80 | Aβ amyloids | Heavy chain | Humanized 12A11, version 6.3 | U.S. Pat. No. 8,784,810 SEQ ID NO: 24 | 3415 |
| AD81 | Aβ amyloids | Heavy chain | Humanized 12A11, version 6.4 | U.S. Pat. No. 8,784,810 SEQ ID NO: 25 | 3416 |
| AD82 | Aβ amyloids | Heavy chain | Humanized 12A11, version 7 | U.S. Pat. No. 8,784,810 SEQ ID NO: 26 | 3417 |
| AD83 | Aβ amyloids | Heavy chain | Humanized 12A11, version 8 | U.S. Pat. No. 8,784,810 SEQ ID NO: 27 | 3418 |
| AD84 | Aβ amyloids | Heavy chain | Humanized 3D6 (Bapineuzumab), version 3 | U.S. Pat. No. 8,784,810 SEQ ID NO: 5 | 3419 |
| AD85 | Aβ amyloids | Heavy chain | Humanized 12A11, version 2 | U.S. Pat. No. 8,784,810 SEQ ID NO: 9 | 3420 |
| AD86 | beta amyloid | Heavy chain | | U.S. Pat. No. 10/476,265 SEQ ID NO: 20 | 3421 |
| AD87 | beta amyloid | Heavy chain | (13C3) | U.S. Pat. No. 13/319,710 SEQ ID NO: 2 | 3422 |
| AD88 | beta amyloid | Heavy chain | | U.S. Pat. No. 13/319,710 SEQ ID NO: 26 | 3423 |
| AD89 | beta amyloid | Heavy chain | C2 | US20070166311 SEQ ID NO: 22 | 3424 |
| AD90 | beta amyloid peptide | Heavy chain | Solanezumab | Immunogenetics Information System; CHAIN ID NO: 9097_H. | 3425 |
| AD91 | beta amyloid peptide | Heavy chain | Mature H1 | WO2007113172 SEQ ID NO: 34 | 3426 |
| AD92 | beta amyloid peptide | Heavy chain | Mature H3 | WO2007113172 SEQ ID NO: 38 | 3427 |
| AD93 | beta-amyloid | Heavy chain | Aducanumab, BIIB0307 | | 3428 |
| AD94 | EAG1 | Heavy chain | chimeric ImAb3 | WO2006037604 SEQ ID NO: 12 | 3022 |
| AD95 | EAG1 | Heavy chain | chimeric ImAb4 | WO2006037604 SEQ ID NO: 16 | 3023 |
| AD96 | EAG1 | Heavy chain | HC-lmAb3-humVH3-72 | WO2006037604 SEQ ID NO: 20 | 3024 |
| AD97 | EAG1 | Heavy chain | HC-lmAb4-humVH4-59 | WO2006037604 SEQ ID NO: 24 | 3025 |

TABLE 4-continued

Alzheimer's Disease Antibodies

| Antibody No. | Target | Description | Antibody Name | Reference Information | SEQ ID NO |
|---|---|---|---|---|---|
| AD98 | EAG1 | Heavy chain | HC-lmAb3-humVH3 23 | WO2006037604 SEQ ID NO: 28 | 3026 |
| AD99 | EAG1 | Heavy chain | HC-lmAb3-humVH2 26 | WO2006037604 SEQ ID NO: 32 | 3027 |
| AD100 | EAG1 | Heavy chain | HC-lmAb4-humVH1-3 | WO2006037604 SEQ ID NO: 36 | 3028 |
| AD101 | EAG1 | Heavy chain | ImAb4 | WO2006037604 SEQ ID NO: 4 | 3029 |
| AD102 | EAG1 | Heavy chain | ImAb3 | WO2006037604 SEQ ID NO: 8 | 3030 |
| AD103 | human beta-amyloid | Heavy chain | Ponezumab, PF-04360365, RN-1219, clone 9TL | U.S. Pat. No. 7,807,165 SEQ ID NO: 11 | 3429 |
| AD104 | IGG1 Abeta | Heavy chain | Humanized C2 | US20090155249 SEQ ID NO: 16 | 3430 |
| AD105 | NOGO | Heavy chain | H6L13 FL | US20140147435 SEQ ID NO: 27 | 3031 |
| AD106 | NOGO | Heavy chain | H16L16 FL, H16L18 FL | US20140147435 SEQ ID NO: 31 | 3032 |
| AD107 | NOGO | Heavy chain | H18L16 FL | US20140147435 SEQ ID NO: 33 | 3033 |
| AD108 | NOGO | Heavy chain | H19L13 FL, H19L16 FL, H19L18 FL | US20140147435 SEQ ID NO: 92 | 3034 |
| AD109 | NOGO | Heavy chain | H20L13 FL, H20L16 FL, H20L18 FL | US20140147435 SEQ ID NO: 93 | 3035 |
| AD110 | NOGO | Heavy chain | H21L13 EL, H21L16 FL, H21L18 FL | US20140147435 SEQ ID NO: 94 | 3036 |
| AD111 | NOGO | Heavy chain | H25L13 FL, H25L16 FL, H25L18 FL | US20140147435 SEQ ID NO: 98 | 3037 |
| AD112 | Nogo receptor-1 | Heavy chain | 5B10 | US20090215691 SEQ ID NO: 16 | 3038 |
| AD113 | Nogo receptor-1 | Heavy chain | 5B10 | US20090215691 SEQ ID NO: 18 | 3039 |
| AD114 | PrPC and/or PrPSc | Heavy chain | | US20150166668 SEQ ID NO: 10 | 3431 |
| AD115 | PrPC and/or PrPSc | Heavy chain | | U.S. Pat. No. 8,852,587 SEQ ID NO: 4 | 3432 |
| AD116 | tau | Heavy chain | VH antibody | US20150252102 SEQ ID NO: 93 | 3433 |
| AD117 | tau | Heavy chain | hACl-36-3A8 Ab1 | WO2013151762 SEQ ID NO: 24 | 3434 |
| AD118 | tau | Heavy chain | hACl-36-3B8 Ab1 | WO2013151762 SEQ ID NO: 25 | 3435 |
| AD119 | tau | Heavy chain | hACl-36-3A8 Ab1.v2 | WO2013151762 SEQ ID NO: 26 | 3436 |
| AD120 | tau | Heavy chain | hACl-36-3A8 Ab1.v3 | WO2013151762 SEQ ID NO: 27 | 3437 |
| AD121 | tau | Heavy chain | hACl-36-3A8 Ab1.v4 | WO2013151762 SEQ ID NO: 28 | 3438 |
| AD122 | tau | Heavy chain | hACl-36-3B8 Ab1.v2 | WO2013151762 SEQ ID NO: 29 | 3439 |
| AD123 | tau | Heavy chain | hACl-36-3B8 Ab1.v3 | WO2013151762 SEQ ID NO: 30 | 3440 |
| AD124 | tau | Heavy chain | hACl-36-3B8 Ab1.v4 | WO2013151762 SEQ ID NO: 31 | 3441 |
| AD125 | tau | Heavy chain | IPN001 | U.S. Pat. No. 8,980,271 SEQ ID NO: 14 | 3442 |
| AD126 | tau | Heavy chain | IPN002 | U.S. Pat. No. 8,980,271 SEQ ID NO: 16 | 3443 |
| AD127 | tau | Heavy chain | ACl-36-3A8-Ab1 and hACl-36-2B6-Ab1 | US20150175682 SEQ ID NO: 16 | 3444 |
| AD128 | tau | Heavy chain | hACl-36-3A8-Ab1 and hACl-36-2B6-Ab1 | US20150175682 SEQ ID NO: 17 | 3445 |
| AD129 | tau | Heavy chain | hACl-36-2B6-Ab1 (IgG4) | US20150175682 SEQ ID NO: 25 | 3446 |
| AD130 | tau | Heavy chain | hACl-36-3A8-Ab1.v2 (IgG4) | US20150175682 SEQ ID NO: 26 | 3447 |
| AD131 | tau | Heavy chain | hACl-36-3A8-Ab1.v3 (IgG1) | US20150175682 SEQ ID NO: 27 | 3448 |
| AD132 | tau | Heavy chain | hACl-36-3A8-Ab1.v4 (IgG1 N297G) | US20150175682 SEQ ID NO: 28 | 3449 |
| AD133 | tau | Heavy chain | hACl-36-2B6-Ab1.v2 (IgG4) | US20150175682 SEQ ID NO: 29 | 3450 |
| AD134 | tau | Heavy chain | hACl-36-2B6-Ab1.v3 (IgG1) | US20150175682 SEQ ID NO: 30 | 3451 |

TABLE 4-continued

Alzheimer's Disease Antibodies

| Antibody No. | Target | Description | Antibody Name | Reference Information | SEQ ID NO |
|---|---|---|---|---|---|
| AD135 | tau | Heavy chain | hACl-36-2B6-Ab1.v4 (IgG1 N297G) | US20150175682 SEQ ID NO: 31 | 3452 |
| AD136 | TrkA | Heavy chain | BXhVH1 | WO2009098238 SEQ ID NO: 1 | 3453 |
| AD137 | TrkA | Heavy chain | mVHEP | WO2009098238 SEQ ID NO: 15 | 3454 |
| AD138 | TrkA | Heavy chain | BXhVH2 | WO2009098238 SEQ ID NO: 2 | 3455 |
| AD139 | TrkA | Heavy chain | BXhVH3 | WO2009098238 SEQ ID NO: 3 | 3456 |
| AD140 | TrkA | Heavy chain | BXhVH4 | WO2009098238 SEQ ID NO: 4 | 3457 |
| AD141 | TrkA | Heavy chain | BXhVH5 | WO2009098238 SEQ ID NO: 5 | 3458 |
| AD142 | TrkA | Heavy chain | HUVHWOV | WO2009098238 SEQ ID NO: 6 | 3459 |
| AD143 | trk-C (NT-3 trkC ligand) | Heavy chain | 2250 | U.S. Pat. No. 7,615,383 SEQ ID NO: 42 | 3040 |
| AD144 | trk-C (NT-3 trkC ligand) | Heavy chain | 2253 | U.S. Pat. No. 7,615,383 SEQ ID NO: 43 | 3041 |
| AD145 | trk-C (NT-3 trkC ligand) | Heavy chain | 2256 | U.S. Pat. No. 7,615,383 SEQ ID NO: 44 | 3042 |
| AD146 | trk-C (NT-3 trkC ligand) | Heavy chain | 6.1.2 | U.S. Pat. No. 7,615,383 SEQ ID NO: 45 | 3043 |
| AD147 | trk-C (NT-3 trkC ligand) | Heavy chain | 6.4.1 | U.S. Pat. No. 7,615,383 SEQ ID NO: 46 | 3044 |
| AD148 | trk-C (NT-3 trkC ligand) | Heavy chain | 2345 | U.S. Pat. No. 7,615,383 SEQ ID NO: 47 | 3045 |
| AD149 | trk-C (NT-3 trkC ligand) | Heavy chain | 2349 | U.S. Pat. No. 7,615,383 SEQ ID NO: 48 | 3046 |
| AD150 | | Heavy chain | Crenezuma heavy CHAIN | | 3460 |
| AD151 | | Heavy chain | Gantenerumab heavy chain | | 3461 |
| AD152 | | Heavy chain | Ponezumab heavy CHAIN | | 3462 |
| AD153 | | Heavy chain | Solanezumab heavy CHAIN | | 3463 |
| AD154 | Aβ amyloid | Heavy chain consensus sequence | | WO2006066049 SEQ ID NO: 21 | 3464 |
| AD155 | Aβ amyloid | Heavy chain consensus sequence | | WO2006066049 SEQ ID NO: 22 | 3465 |
| AD156 | Aβ amyloid | Heavy chain consensus sequence | | WO2006066049 SEQ ID NO: 23 | 3466 |
| AD157 | Aβ amyloid | Heavy chain consensus sequence | | WO2006066049 SEQ ID NO: 24 | 3467 |
| AD158 | Aβ amyloid | Heavy chain consensus sequence | | WO2006066049 SEQ ID NO: 25 | 3468 |
| AD159 | Aβ amyloid | Heavy chain consensus sequence | | WO2006066049 SEQ ID NO: 26 | 3469 |
| AD160 | Aβ amyloid | Heavy chain consensus sequence | | WO2006066049 SEQ ID NO: 27 | 3470 |
| AD161 | BACE1 | Heavy chain variable (nanobody) | Nanobody B1 | WO2009121948 SEQ ID NO: 1 | 3471 |
| AD162 | BACE10 | Heavy chain variable (nanobody) | Nanobody B15 | WO2009121948 SEQ ID NO: 10 | 3472 |
| AD163 | BACE11 | Heavy chain variable (nanobody) | Nanobody B16 | WO2009121948 SEQ ID NO: 11 | 3473 |
| AD164 | BACE12 | Heavy chain variable (nanobody) | Nanobody B21 | WO2009121948 SEQ ID NO: 12 | 3474 |
| AD165 | BACE13 | Heavy chain variable (nanobody) | Nanobody B25 | WO2009121948 SEQ ID NO: 13 | 3475 |

TABLE 4-continued

Alzheimer's Disease Antibodies

| Antibody No. | Target | Description | Antibody Name | Reference Information | SEQ ID NO |
|---|---|---|---|---|---|
| AD166 | BACE14 | Heavy chain variable (nanobody) | Nanobody B26 | WO2009121948 SEQ ID NO: 14 | 3476 |
| AD167 | BACE15 | Heavy chain variable (nanobody) | Nanobody 1B3 | WO2009121948 SEQ ID NO: 15 | 3477 |
| AD168 | BACE16 | Heavy chain variable (nanobody) | Nanobody 10C2 | WO2009121948 SEQ ID NO: 16 | 3478 |
| AD169 | BACE17 | Heavy chain variable (nanobody) | Nanobody 12B6 | WO2009121948 SEQ ID NO: 17 | 3479 |
| AD170 | BACE18 | Heavy chain variable (nanobody) | Nanobody 10B5 | WO2009121948 SEQ ID NO: 18 | 3480 |
| AD171 | BACE19 | Heavy chain variable (nanobody) | Nanobody 13A5 | WO2009121948 SEQ ID NO: 19 | 3481 |
| AD172 | BACE2 | Heavy chain variable (nanobody) | Nanobody B2 | WO2009121948 SEQ ID NO: 2 | 3482 |
| AD173 | BACE20 | Heavy chain variable (nanobody) | Nanobody 2C6 | WO2009121948 SEQ ID NO: 20 | 3483 |
| AD174 | BACE21 | Heavy chain variable (nanobody) | Nanobody 6A4 | WO2009121948 SEQ ID NO: 21 | 3484 |
| AD175 | BACE22 | Heavy chain variable (nanobody) | Nanobody 10C4 | WO2009121948 SEQ ID NO: 22 | 3485 |
| AD176 | BACE23 | Heavy chain variable (nanobody) | Nanobody 13B6 | WO2009121948 SEQ ID NO: 23 | 3486 |
| AD177 | BACE24 | Heavy chain variable (nanobody) | Nanobody 1A4 | WO2009121948 SEQ ID NO: 24 | 3487 |
| AD178 | BACE25 | Heavy chain variable (nanobody) | Nanobody 2B6 | WO2009121948 SEQ ID NO: 25 | 3488 |
| AD179 | BACE26 | Heavy chain variable (nanobody) | Nanobody 4A2 | WO2009121948 SEQ ID NO: 26 | 3489 |
| AD180 | BACE27 | Heavy chain variable (nanobody) | Nanobody 1 D4 | WO2009121948 SEQ ID NO: 27 | 3490 |
| AD181 | BACE28 | Heavy chain variable (nanobody) | Nanobody 9D3 | WO2009121948 SEQ ID NO: 28 | 3491 |
| AD182 | BACE3 | Heavy chain variable (nanobody) | Nanobody B3 | WO2009121948 SEQ ID NO: 3 | 3492 |
| AD183 | BACE4 | Heavy chain variable (nanobody) | Nanobody B5 | WO2009121948 SEQ ID NO: 4 | 3493 |
| AD184 | BACE5 | Heavy chain variable (nanobody) | Nanobody B8 | WO2009121948 SEQ ID NO: 5 | 3494 |
| AD185 | BACE6 | Heavy chain variable (nanobody) | Nanobody B9 | WO2009121948 SEQ ID NO: 6 | 3495 |
| AD186 | BACE7 | Heavy chain variable (nanobody) | Nanobody B10 | WO2009121948 SEQ ID NO: 7 | 3496 |
| AD187 | BACE8 | Heavy chain variable (nanobody) | Nanobody B11 | WO2009121948 SEQ ID NO: 8 | 3497 |
| AD188 | BACE9 | Heavy chain variable (nanobody) | Nanobody B12 | WO2009121948 SEQ ID NO: 9 | 3498 |
| AD189 | amyloid protein | Heavy chain constant region | IG GAMMA-4 CHAIN C REGION modified | US20100150906 SEQ ID NO: 17 | 3499 |
| AD190 | tau | Heavy chain constant region | hACl-36-3A8-Ab1 and hACl-36-2B6-Ab1 | US20150175682 SEQ ID NO: 14 | 3500 |

TABLE 4-continued

Alzheimer's Disease Antibodies

| Antibody No. | Target | Description | Antibody Name | Reference Information | SEQ ID NO |
|---|---|---|---|---|---|
| AD191 | ApoE | Heavy chain fragment | 2e8 Fab | Trakhanov, S. et al. "Structure of a monoclonal 2E8 Fab antibody fragment specific for the low-density lipoprotein-receptor binding region of apolipoprotein E refined at 1.9 A", Acta Crystallogr. D Biol. Crystallogr. 55 (PT 1), 122-128 (1999), NCBI Accession # 12E8 P | 3501 |
| AD192 | many-growth factors | Heavy chain fusion protein | H19L13, H19L16, H19L18, H19L14, H19L15, H19L17, H19L6, H19L11 | U.S. Pat. No. 8,053,569 SEQ ID NO: 25 | 3056 |
| AD193 | many-growth factors | Heavy chain fusion protein | H20L13, H20L16, H20L18, H20L14, H20L15, H20L17, H20L6, H20L11 | U.S. Pat. No. 8,053,569 SEQ ID NO: 28 | 3057 |
| AD194 | many-growth factors | Heavy chain fusion protein | H22L13, H22L16, H22L18, H22L14, H22L15, H22L17, H22L6, H22L11 | U.S. Pat. No. 8,053,569 SEQ ID NO: 34 | 3058 |
| AD195 | many-growth factors | Heavy chain fusion protein | H5L11, H6L11, H14L11, H15L11, H16L11, H17L11, H18L11, H19L11, H20L11, H21L11, H22L11, H23L11, H24L11, H25L11, H700L11 | U.S. Pat. No. 8,053,569 SEQ ID NO: 24 | 3059 |
| AD196 | NOGO | Heavy chain humanized construct H1 | 2A10 construct | WO2007003421 SEQ ID NO: 79 | 3060 |
| AD197 | NOGO | Heavy chain humanized construct H14 | 2A10 construct | WO2007003421 SEQ ID NO: 29 | 3061 |
| AD198 | NOGO | Heavy chain humanized construct H15 | 2A10 construct | WO2007003421 SEQ ID NO: 30 | 3062 |
| AD199 | NOGO | Heavy chain humanized construct H16 | 2A10 construct | WO2007003421 SEQ ID NO: 31 | 3063 |
| AD200 | NOGO | Heavy chain humanized construct H17 | 2A10 construct | WO2007003421 SEQ ID NO: 32 | 3064 |
| AD201 | NOGO | Heavy chain humanized construct H18 | 2A10 construct | WO2007003421 SEQ ID NO: 33 | 3065 |
| AD202 | NOGO | Heavy chain humanized construct H19 | 2A10 construct | WO2007003421 SEQ ID NO: 92 | 3066 |
| AD203 | NOGO | Heavy chain humanized construct H20 | 2A10 construct | WO2007003421 SEQ ID NO: 93 | 3067 |
| AD204 | NOGO | Heavy chain humanized construct H21 | 2A10 construct | WO2007003421 SEQ ID NO: 94 | 3068 |
| AD205 | NOGO | Heavy chain humanized construct H22 | 2A10 construct | WO2007003421 SEQ ID NO: 95 | 3069 |
| AD206 | NOGO | Heavy chain humanized construct H23 | 2A10 construct | WO2007003421 SEQ ID NO: 96 | 3070 |
| AD207 | NOGO | Heavy chain humanized construct H24 | 2A10 construct | WO2007003421 SEQ ID NO: 97 | 3071 |

TABLE 4-continued

Alzheimer's Disease Antibodies

| Antibody No. | Target | Description | Antibody Name | Reference Information | SEQ ID NO |
|---|---|---|---|---|---|
| AD208 | NOGO | Heavy chain humanized construct H25 | 2A10 construct | WO2007003421 SEQ ID NO: 98 | 3072 |
| AD209 | NOGO | Heavy chain humanized construct H5 | 2A10 construct | WO2007003421 SEQ ID NO: 26 | 3073 |
| AD210 | NOGO | Heavy chain humanized construct H6 | 2A10 construct | WO2007003421 SEQ ID NO: 27 | 3074 |
| AD211 | NOGO | Heavy chain humanized construct H700 | 2A10 construct | WO2007003421 SEQ ID NO: 28 | 3075 |
| AD212 | RTN4 (NOGO) | Heavy chain IgG4, immunomodultator | Atinumab | U.S. Pat. No. 8,163,285 SEQ ID NO: 24 | 3076 |
| AD213 | tau | Heavy chain mature | ch4E4 | US20150252102 SEQ ID NO: 20 | 3502 |
| AD214 | tau | Heavy chain mature | ch4E4(N30Q) | US20150252102 SEQ ID NO: 22 | 3503 |
| AD215 | A beta oligomers | Heavy chain variable region | IR-072 | U.S. Pat. No. 8,858,949 SEQ ID NO: 1010 | 3504 |
| AD216 | A beta oligomers | Heavy chain variable region | IR-011 | U.S. Pat. No. 8,858,949 SEQ ID NO: 114 | 3505 |
| AD217 | A beta oligomers | Heavy chain variable region | IR-030 | U.S. Pat. No. 8,858,949 SEQ ID NO: 370 | 3506 |
| AD218 | A beta oligomers | Heavy chain variable region | IR-031 | U.S. Pat. No. 8,858,949 SEQ ID NO: 386 | 3507 |
| AD219 | A beta oligomers | Heavy chain variable region | IR-032 | U.S. Pat. No. 8,858,949 SEQ ID NO: 402 | 3508 |
| AD220 | A beta oligomers | Heavy chain variable region | IR-033 | U.S. Pat. No. 8,858,949 SEQ ID NO: 418 | 3509 |
| AD221 | A beta oligomers | Heavy chain variable region | IR-034 | U.S. Pat. No. 8,858,949 SEQ ID NO: 434 | 3510 |
| AD222 | A beta oligomers | Heavy chain variable region | IR-035 | U.S. Pat. No. 8,858,949 SEQ ID NO: 450 | 3511 |
| AD223 | A beta oligomers | Heavy chain variable region | IR-036 | U.S. Pat. No. 8,858,949 SEQ ID NO: 466 | 3512 |
| AD224 | A beta oligomers | Heavy chain variable region | IR-037 | U.S. Pat. No. 8,858,949 SEQ ID NO: 482 | 3513 |
| AD225 | A beta oligomers | Heavy chain variable region | IR-038 | U.S. Pat. No. 8,858,949 SEQ ID NO: 498 | 3514 |
| AD226 | A beta oligomers | Heavy chain variable region | IR-005 | U.S. Pat. No. 8,858,949 SEQ ID NO: 50 | 3515 |
| AD227 | A beta oligomers | Heavy chain variable region | IR-081 | U.S. Pat. No. 8,858,949 SEQ ID NO: 1154 | 3516 |
| AD228 | A beta oligomers | Heavy chain variable region | IR-039 | U.S. Pat. No. 8,858,949 SEQ ID NO: 514 | 3517 |
| AD229 | A beta oligomers | Heavy chain variable region | IR-040 | U.S. Pat. No. 8,858,949 SEQ ID NO: 530 | 3518 |
| AD230 | A beta oligomers | Heavy chain variable region | IR-041 | U.S. Pat. No. 8,858,949 SEQ ID NO: 546 | 3519 |
| AD231 | A beta oligomers | Heavy chain variable region | IR-043 | U.S. Pat. No. 8,858,949 SEQ ID NO: 562 | 3520 |
| AD232 | A beta oligomers | Heavy chain variable region | IR-044 | U.S. Pat. No. 8,858,949 SEQ ID NO: 578 | 3521 |
| AD233 | A beta oligomers | Heavy chain variable region | IR-045 | U.S. Pat. No. 8,858,949 SEQ ID NO: 594 | 3522 |
| AD234 | A beta oligomers | Heavy chain variable region | IR-046 | U.S. Pat. No. 8,858,949 SEQ ID NO: 610 | 3523 |
| AD235 | A beta oligomers | Heavy chain variable region | IR-048 | U.S. Pat. No. 8,858,949 SEQ ID NO: 626 | 3524 |
| AD236 | A beta oligomers | Heavy chain variable region | IR-049 | U.S. Pat. No. 8,858,949 SEQ ID NO: 642 | 3525 |
| AD237 | A beta oligomers | Heavy chain variable region | IR-050 | U.S. Pat. No. 8,858,949 SEQ ID NO: 658 | 3526 |
| AD238 | A beta oligomers | Heavy chain variable region | IR-082 | U.S. Pat. No. 8,858,949 SEQ ID NO: 1170 | 3527 |
| AD239 | A beta oligomers | Heavy chain variable region | IR-006 | U.S. Pat. No. 8,858,949 SEQ ID NO: 66 | 3528 |
| AD240 | A beta oligomers | Heavy chain variable region | IR-051 | U.S. Pat. No. 8,858,949 SEQ ID NO: 674 | 3529 |
| AD241 | A beta oligomers | Heavy chain variable region | IR-052 | U.S. Pat. No. 8,858,949 SEQ ID NO: 690 | 3530 |
| AD242 | A beta oligomers | Heavy chain variable region | IR-053 | U.S. Pat. No. 8,858,949 SEQ ID NO: 706 | 3531 |

TABLE 4-continued

Alzheimer's Disease Antibodies

| Antibody No. | Target | Description | Antibody Name | Reference Information | SEQ ID NO |
|---|---|---|---|---|---|
| AD243 | A beta oligomers | Heavy chain variable region | IR-054 | U.S. Pat. No. 8,858,949 SEQ ID NO: 722 | 3532 |
| AD244 | A beta oligomers | Heavy chain variable region | IR-055 | U.S. Pat. No. 8,858,949 SEQ ID NO: 738 | 3533 |
| AD245 | A beta oligomers | Heavy chain variable region | IR-056 | U.S. Pat. No. 8,858,949 SEQ ID NO: 754 | 3534 |
| AD246 | A beta oligomers | Heavy chain variable region | IR-057 | U.S. Pat. No. 8,858,949 SEQ ID NO: 770 | 3535 |
| AD247 | A beta oligomers | Heavy chain variable region | IR-058 | U.S. Pat. No. 8,858,949 SEQ ID NO: 786 | 3536 |
| AD248 | A beta oligomers | Heavy chain variable region | IR-059 | U.S. Pat. No. 8,858,949 SEQ ID NO: 802 | 3537 |
| AD249 | A beta oligomers | Heavy chain variable region | IR-083 | U.S. Pat. No. 8,858,949 SEQ ID NO: 1186 | 3538 |
| AD250 | A beta oligomers | Heavy chain variable region | IR-060 | U.S. Pat. No. 8,858,949 SEQ ID NO: 818 | 3539 |
| AD251 | A beta oligomers | Heavy chain variable region | IR-007 | U.S. Pat. No. 8,858,949 SEQ ID NO: 82 | 3540 |
| AD252 | A beta oligomers | Heavy chain variable region | IR-061 | U.S. Pat. No. 8,858,949 SEQ ID NO: 834 | 3541 |
| AD253 | A beta oligomers | Heavy chain variable region | IR-062 | U.S. Pat. No. 8,858,949 SEQ ID NO: 850 | 3542 |
| AD254 | A beta oligomers | Heavy chain variable region | IR-063 | U.S. Pat. No. 8,858,949 SEQ ID NO: 866 | 3543 |
| AD255 | A beta oligomers | Heavy chain variable region | IR-064 | U.S. Pat. No. 8,858,949 SEQ ID NO: 882 | 3544 |
| AD256 | A beta oligomers | Heavy chain variable region | IR-065 | U.S. Pat. No. 8,858,949 SEQ ID NO: 898 | 3545 |
| AD257 | A beta oligomers | Heavy chain variable region | IR-066 | U.S. Pat. No. 8,858,949 SEQ ID NO: 914 | 3546 |
| AD258 | A beta oligomers | Heavy chain variable region | IR-067 | U.S. Pat. No. 8,858,949 SEQ ID NO: 930 | 3547 |
| AD259 | A beta oligomers | Heavy chain variable region | IR-068 | U.S. Pat. No. 8,858,949 SEQ ID NO: 946 | 3548 |
| AD260 | A beta oligomers | Heavy chain variable region | IR-084 | U.S. Pat. No. 8,858,949 SEQ ID NO: 1202 | 3549 |
| AD261 | A beta oligomers | Heavy chain variable region | IR-069 | U.S. Pat. No. 8,858,949 SEQ ID NO: 962 | 3550 |
| AD262 | A beta oligomers | Heavy chain variable region | IR-070 | U.S. Pat. No. 8,858,949 SEQ ID NO: 978 | 3551 |
| AD263 | A beta oligomers | Heavy chain variable region | IR-008 | U.S. Pat. No. 8,858,949 SEQ ID NO: 98 | 3552 |
| AD264 | A beta oligomers | Heavy chain variable region | IR-071 | U.S. Pat. No. 8,858,949 SEQ ID NO: 994 | 3553 |
| AD265 | A beta oligomers | Heavy chain variable region | IR-001 | U.S. Pat. No. 8,858,949 SEQ ID NO: 2 | 3554 |
| AD266 | A beta oligomers | Heavy chain variable region | IR-161 | U.S. Pat. No. 8,858,949 SEQ ID NO: 2878 | 3555 |
| AD267 | A beta oligomers | Heavy chain variable region | IR-085 | U.S. Pat. No. 8,858,949 SEQ ID NO: 1218 | 3556 |
| AD268 | A beta oligomers | Heavy chain variable region | IR-086 | U.S. Pat. No. 8,858,949 SEQ ID NO: 1234 | 3557 |
| AD269 | A beta oligomers | Heavy chain variable region | IR-087 | U.S. Pat. No. 8,858,949 SEQ ID NO: 1250 | 3558 |
| AD270 | A beta oligomers | Heavy chain variable region | IR-088 | U.S. Pat. No. 8,858,949 SEQ ID NO: 1266 | 3559 |
| AD271 | A beta oligomers | Heavy chain variable region | IR-089 | U.S. Pat. No. 8,858,949 SEQ ID NO: 1282 | 3560 |
| AD272 | A beta oligomers | Heavy chain variable region | IR-073 | U.S. Pat. No. 8,858,949 SEQ ID NO: 1026 | 3561 |
| AD273 | A beta oligomers | Heavy chain variable region | IR-090 | U.S. Pat. No. 8,858,949 SEQ ID NO: 1298 | 3562 |
| AD274 | A beta oligomers | Heavy chain variable region | IR-012 | U.S. Pat. No. 8,858,949 SEQ ID NO: 130 | 3563 |
| AD275 | A beta oligomers | Heavy chain variable region | IR-092 | U.S. Pat. No. 8,858,949 SEQ ID NO: 1314 | 3564 |
| AD276 | A beta oligomers | Heavy chain variable region | IR-093 | U.S. Pat. No. 8,858,949 SEQ ID NO: 1330 | 3565 |
| AD277 | A beta oligomers | Heavy chain variable region | IR-094 | U.S. Pat. No. 8,858,949 SEQ ID NO: 1346 | 3566 |
| AD278 | A beta oligomers | Heavy chain variable region | IR-095 | U.S. Pat. No. 8,858,949 SEQ ID NO: 1362 | 3567 |
| AD279 | A beta oligomers | Heavy chain variable region | IR-097 | U.S. Pat. No. 8,858,949 SEQ ID NO: 1378 | 3568 |

TABLE 4-continued

Alzheimer's Disease Antibodies

| Antibody No. | Target | Description | Antibody Name | Reference Information | SEQ ID NO |
|---|---|---|---|---|---|
| AD280 | A beta oligomers | Heavy chain variable region | IR-098 | U.S. Pat. No. 8,858,949 SEQ ID NO: 1394 | 3569 |
| AD281 | A beta oligomers | Heavy chain variable region | IR-100 | U.S. Pat. No. 8,858,949 SEQ ID NO: 1410 | 3570 |
| AD282 | A beta oligomers | Heavy chain variable region | IR-101 | U.S. Pat. No. 8,858,949 SEQ ID NO: 1426 | 3571 |
| AD283 | A beta oligomers | Heavy chain variable region | IR-074 | U.S. Pat. No. 8,858,949 SEQ ID NO: 1042 | 3572 |
| AD284 | A beta oligomers | Heavy chain variable region | IR-102 | U.S. Pat. No. 8,858,949 SEQ ID NO: 1442 | 3573 |
| AD285 | A beta oligomers | Heavy chain variable region | IR-104 | U.S. Pat. No. 8,858,949 SEQ ID NO: 1458 | 3574 |
| AD286 | A beta oligomers | Heavy chain variable region | IR-013 | U.S. Pat. No. 8,858,949 SEQ ID NO: 146 | 3575 |
| AD287 | A beta oligomers | Heavy chain variable region | IR-105 | U.S. Pat. No. 8,858,949 SEQ ID NO: 1474 | 3576 |
| AD288 | A beta oligomers | Heavy chain variable region | IR-106 | U.S. Pat. No. 8,858,949 SEQ ID NO: 1490 | 3577 |
| AD289 | A beta oligomers | Heavy chain variable region | IR-107 | U.S. Pat. No. 8,858,949 SEQ ID NO: 1506 | 3578 |
| AD290 | A beta oligomers | Heavy chain variable region | IR-108 | U.S. Pat. No. 8,858,949 SEQ ID NO: 1522 | 3579 |
| AD291 | A beta oligomers | Heavy chain variable region | IR-109 | U.S. Pat. No. 8,858,949 SEQ ID NO: 1538 | 3580 |
| AD292 | A beta oligomers | Heavy chain variable region | IR-110 | U.S. Pat. No. 8,858,949 SEQ ID NO: 1554 | 3581 |
| AD293 | A beta oligomers | Heavy chain variable region | IR-112 | U.S. Pat. No. 8,858,949 SEQ ID NO: 1570 | 3582 |
| AD294 | A beta oligomers | Heavy chain variable region | IR-075 | U.S. Pat. No. 8,858,949 SEQ ID NO: 1058 | 3583 |
| AD295 | A beta oligomers | Heavy chain variable region | IR-114 | U.S. Pat. No. 8,858,949 SEQ ID NO: 1586 | 3584 |
| AD296 | A beta oligomers | Heavy chain variable region | IR-115 | U.S. Pat. No. 8,858,949 SEQ ID NO: 1602 | 3585 |
| AD297 | A beta oligomers | Heavy chain variable region | IR-116 | U.S. Pat. No. 8,858,949 SEQ ID NO: 1618 | 3586 |
| AD298 | A beta oligomers | Heavy chain variable region | IR-014 | U.S. Pat. No. 8,858,949 SEQ ID NO: 162 | 3587 |
| AD299 | A beta oligomers | Heavy chain variable region | IR-117 | U.S. Pat. No. 8,858,949 SEQ ID NO: 1634 | 3588 |
| AD300 | A beta oligomers | Heavy chain variable region | IR-118 | U.S. Pat. No. 8,858,949 SEQ ID NO: 1650 | 3589 |
| AD301 | A beta oligomers | Heavy chain variable region | IR-119 | U.S. Pat. No. 8,858,949 SEQ ID NO: 1666 | 3590 |
| AD302 | A beta oligomers | Heavy chain variable region | IR-120 | U.S. Pat. No. 8,858,949 SEQ ID NO: 1682 | 3591 |
| AD303 | A beta oligomers | Heavy chain variable region | IR-121 | U.S. Pat. No. 8,858,949 SEQ ID NO: 1698 | 3592 |
| AD304 | A beta oligomers | Heavy chain variable region | IR-122 | U.S. Pat. No. 8,858,949 SEQ ID NO: 1714 | 3593 |
| AD305 | A beta oligomers | Heavy chain variable region | IR-076 | U.S. Pat. No. 8,858,949 SEQ ID NO: 1074 | 3594 |
| AD306 | A beta oligomers | Heavy chain variable region | IR-123 | U.S. Pat. No. 8,858,949 SEQ ID NO: 1730 | 3595 |
| AD307 | A beta oligomers | Heavy chain variable region | IR-124 | U.S. Pat. No. 8,858,949 SEQ ID NO: 1746 | 3596 |
| AD308 | A beta oligomers | Heavy chain variable region | IR-125 | U.S. Pat. No. 8,858,949 SEQ ID NO: 1762 | 3597 |
| AD309 | A beta oligomers | Heavy chain variable region | IR-126 | U.S. Pat. No. 8,858,949 SEQ ID NO: 1778 | 3598 |
| AD310 | A beta oligomers | Heavy chain variable region | IR-015 | U.S. Pat. No. 8,858,949 SEQ ID NO: 178 | 3599 |
| AD311 | A beta oligomers | Heavy chain variable region | IR-127 | U.S. Pat. No. 8,858,949 SEQ ID NO: 1794 | 3600 |
| AD312 | A beta oligomers | Heavy chain variable region | IR-002 | U.S. Pat. No. 8,858,949 SEQ ID NO: 18 | 3601 |
| AD313 | A beta oligomers | Heavy chain variable region | IR-128 | U.S. Pat. No. 8,858,949 SEQ ID NO: 1810 | 3602 |
| AD314 | A beta oligomers | Heavy chain variable region | IR-129 | U.S. Pat. No. 8,858,949 SEQ ID NO: 1826 | 3603 |
| AD315 | A beta oligomers | Heavy chain variable region | IR-131 | U.S. Pat. No. 8,858,949 SEQ ID NO: 1842 | 3604 |
| AD316 | A beta oligomers | Heavy chain variable region | IR-077 | U.S. Pat. No. 8,858,949 SEQ ID NO: 1090 | 3605 |

TABLE 4-continued

Alzheimer's Disease Antibodies

| Antibody No. | Target | Description | Antibody Name | Reference Information | SEQ ID NO |
|---|---|---|---|---|---|
| AD317 | A beta oligomers | Heavy chain variable region | IR-132 | U.S. Pat. No. 8,858,949 SEQ ID NO: 1858 | 3606 |
| AD318 | A beta oligomers | Heavy chain variable region | IR-133 | U.S. Pat. No. 8,858,949 SEQ ID NO: 1874 | 3607 |
| AD319 | A beta oligomers | Heavy chain variable region | IR-134 | U.S. Pat. No. 8,858,949 SEQ ID NO: 1890 | 3608 |
| AD320 | A beta oligomers | Heavy chain variable region | IR-135 | U.S. Pat. No. 8,858,949 SEQ ID NO: 1906 | 3609 |
| AD321 | A beta oligomers | Heavy chain variable region | IR-136 | U.S. Pat. No. 8,858,949 SEQ ID NO: 1922 | 3610 |
| AD322 | A beta oligomers | Heavy chain variable region | IR-137 | U.S. Pat. No. 8,858,949 SEQ ID NO: 1938 | 3611 |
| AD323 | A beta oligomers | Heavy chain variable region | IR-017 | U.S. Pat. No. 8,858,949 SEQ ID NO: 194 | 3612 |
| AD324 | A beta oligomers | Heavy chain variable region | IR-138 | U.S. Pat. No. 8,858,949 SEQ ID NO: 1954 | 3613 |
| AD325 | A beta oligomers | Heavy chain variable region | IR-139 | U.S. Pat. No. 8,858,949 SEQ ID NO: 1970 | 3614 |
| AD326 | A beta oligomers | Heavy chain variable region | IR-140 | U.S. Pat. No. 8,858,949 SEQ ID NO: 1986 | 3615 |
| AD327 | A beta oligomers | Heavy chain variable region | IR-078 | U.S. Pat. No. 8,858,949 SEQ ID NO: 1106 | 3616 |
| AD328 | A beta oligomers | Heavy chain variable region | IR-141 | U.S. Pat. No. 8,858,949 SEQ ID NO: 2002 | 3617 |
| AD329 | A beta oligomers | Heavy chain variable region | IR-142 | U.S. Pat. No. 8,858,949 SEQ ID NO: 2018 | 3618 |
| AD330 | A beta oligomers | Heavy chain variable region | IR-143 | U.S. Pat. No. 8,858,949 SEQ ID NO: 2034 | 3619 |
| AD331 | A beta oligomers | Heavy chain variable region | IR-144 | U.S. Pat. No. 8,858,949 SEQ ID NO: 2050 | 3620 |
| AD332 | A beta oligomers | Heavy chain variable region | IR-145 | U.S. Pat. No. 8,858,949 SEQ ID NO: 2066 | 3621 |
| AD333 | A beta oligomers | Heavy chain variable region | IR-146 | U.S. Pat. No. 8,858,949 SEQ ID NO: 2082 | 3622 |
| AD334 | A beta oligomers | Heavy chain variable region | IR-147 | U.S. Pat. No. 8,858,949 SEQ ID NO: 2098 | 3623 |
| AD335 | A beta oligomers | Heavy chain variable region | IR-020 | U.S. Pat. No. 8,858,949 SEQ ID NO: 210 | 3624 |
| AD336 | A beta oligomers | Heavy chain variable region | IR-149 | U.S. Pat. No. 8,858,949 SEQ ID NO: 2114 | 3625 |
| AD337 | A beta oligomers | Heavy chain variable region | IR-150 | U.S. Pat. No. 8,858,949 SEQ NO: 2130 | 3626 |
| AD338 | A beta oligomers | Heavy chain variable region | IR-079 | U.S. Pat. No. 8,858,949 SEQ ID NO: 1122 | 3627 |
| AD339 | A beta oligomers | Heavy chain variable region | IR-151 | U.S. Pat. No. 8,858,949 SEQ ID NO: 2146 | 3628 |
| AD340 | A beta oligomers | Heavy chain variable region | IR-152 | U.S. Pat. No. 8,858,949 SEQ ID NO: 2162 | 3629 |
| AD341 | A beta oligomers | Heavy chain variable region | IR-153 | U.S. Pat. No. 8,858,949 SEQ ID NO: 2178 | 3630 |
| AD342 | A beta oligomers | Heavy chain variable region | IR-154 | U.S. Pat. No. 8,858,949 SEQ ID NO: 2194 | 3631 |
| AD343 | A beta oligomers | Heavy chain variable region | IR-155 | U.S. Pat. No. 8,858,949 SEQ ID NO: 2210 | 3632 |
| AD344 | A beta oligomers | Heavy chain variable region | IR-156 | U.S. Pat. No. 8,858,949 SEQ ID NO: 2226 | 3633 |
| AD345 | A beta oligomers | Heavy chain variable region | IR-157 | U.S. Pat. No. 8,858,949 SEQ ID NO: 2242 | 3634 |
| AD346 | A beta oligomers | Heavy chain variable region | IR-158 | U.S. Pat. No. 8,858,949 SEQ ID NO: 2258 | 3635 |
| AD347 | A beta oligomers | Heavy chain variable region | IR-021 | U.S. Pat. No. 8,858,949 SEQ ID NO: 226 | 3636 |
| AD348 | A beta oligomers | Heavy chain variable region | IR-159 | U.S. Pat. No. 8,858,949 SEQ ID NO: 2274 | 3637 |
| AD349 | A beta oligomers | Heavy chain variable region | IR-080 | U.S. Pat. No. 8,858,949 SEQ ID NO: 1138 | 3638 |
| AD350 | A beta oligomers | Heavy chain variable region | IR-022 | U.S. Pat. No. 8,858,949 SEQ ID NO: 242 | 3639 |
| AD351 | A beta oligomers | Heavy chain variable region | IR-023 | U.S. Pat. No. 8,858,949 SEQ ID NO: 258 | 3640 |
| AD352 | A beta oligomers | Heavy chain variable region | IR-024 | U.S. Pat. No. 8,858,949 SEQ ID NO: 274 | 3641 |
| AD353 | A beta oligomers | Heavy chain variable region | IR-160 | U.S. Pat. No. 8,858,949 SEQ ID NO: 2862 | 3642 |

TABLE 4-continued

Alzheimer's Disease Antibodies

| Antibody No. | Target | Description | Antibody Name | Reference Information | SEQ ID NO |
|---|---|---|---|---|---|
| AD354 | A beta oligomers | Heavy chain variable region | IR-025 | U.S. Pat. No. 8,858,949 SEQ ID NO: 290 | 3643 |
| AD355 | A beta oligomers | Heavy chain variable region | IR-026 | U.S. Pat. No. 8,858,949 SEQ ID NO: 306 | 3644 |
| AD356 | A beta oligomers | Heavy chain variable region | IR-027 | U.S. Pat. No. 8,858,949 SEQ ID NO: 322 | 3645 |
| AD357 | A beta oligomers | Heavy chain variable region | IR-028 | U.S. Pat. No. 8,858,949 SEQ ID NO: 338 | 3646 |
| AD358 | A beta oligomers | Heavy chain variable region | IR-004 | U.S. Pat. No. 8,858,949 SEQ ID NO: 34 | 3647 |
| AD359 | A beta oligomers | Heavy chain variable region | IR-029 | U.S. Pat. No. 8,858,949 SEQ ID NO: 354 | 3648 |
| AD360 | AB (1-42) Globulomer | Heavy chain variable region | 8F5 hum8 VL | US20090232801 SEQ ID NO: 1 | 3649 |
| AD361 | AB (1-42) Globulomer | Heavy chain variable region | Hu8F5VHv1 | US20090232801 SEQ ID NO: 101 | 3650 |
| AD362 | AB (1-42) Globulomer | Heavy chain variable region | Hu8F5VHv2 | US20090232801 SEQ ID NO: 102 | 3651 |
| AD363 | AB (1-42) Globulomer | Heavy chain variable region | Hu8F5VHv1 | US20090232801 SEQ ID NO: 108 | 3652 |
| AD364 | AB (1-42) Globulomer | Heavy chain variable region | Hu8F5VHv2 | US20090232801 SEQ ID NO: 110 | 3653 |
| AD365 | AB (20-42) Globulomer | Heavy chain variable region | VH 5F7hum8 | US20090175847 SEQ ID NO: 1 | 3654 |
| AD366 | AB (20-42) Globulomer | Heavy chain variable region | VH 7C6hum7 | US20090175847 SEQ ID NO: 3 | 3655 |
| AD367 | ADDL | Heavy chain variable region | | WO2007050359 SEQ ID NO: 108 | 3656 |
| AD368 | ADDL | Heavy chain variable region | | WO2007050359 SEQ ID NO: 138 | 3657 |
| AD369 | amyloid beta peptide Aβ | Heavy chain variable region | | U.S. Pat. No. 719,576 SEQ ID NO: 10 | 3658 |
| AD370 | amyloid beta peptide Aβ | Heavy chain variable region | | U.S. Pat. No. 719,576 SEQ ID NO: 8 | 3659 |
| AD371 | amyloid oligomers | Heavy chain variable region | F11G3 | U.S. Pat. No. 9,125,846 SEQ ID NO: 11 | 3110 |
| AD372 | amyloid or amyloid-like proteins | Heavy chain variable region | Humanized C2 HIV AF 4 | WO2008061796 SEQ ID NO: 3 | 3660 |
| AD373 | amyloid protein (IGG1 Abeta) | Heavy chain variable region | C2 HIV AF 4 | US20100150906 SEQ ID NO: 15 | 3661 |
| AD374 | amyloid β peptide | Heavy chain variable region | Fv1E1 | U.S. Pat. No. 8,222,002 SEQ ID NO: 1 | 3662 |
| AD375 | amyloid β peptide | Heavy chain variable region | VLA2 | U.S. Pat. No. 8,222,002 SEQ ID NO: 101 | 3663 |
| AD376 | amyloid β peptide | Heavy chain variable region | Fv1E4 | U.S. Pat. No. 8,222,002 SEQ ID NO: 11 | 3664 |
| AD377 | amyloid β peptide | Heavy chain variable region | Fv1E7 | U.S. Pat. No. 8,222,002 SEQ ID NO: 21 | 3665 |
| AD378 | amyloid β peptide | Heavy chain variable region | Fv2A7 | U.S. Pat. No. 8,222,002 SEQ ID NO: 31 | 3666 |
| AD379 | amyloid β peptide | Heavy chain variable region | Fv2A8 | U.S. Pat. No. 8,222,002 SEQ ID NO: 41 | 3667 |
| AD380 | amyloid β peptide | Heavy chain variable region | Fv2B6 | U.S. Pat. No. 8,222,002 SEQ ID NO: 51 | 3668 |
| AD381 | amyloid β peptide | Heavy chain variable region | B7 | U.S. Pat. No. 8,222,002 SEQ ID NO: 61 | 3669 |
| AD382 | amyloid β peptide | Heavy chain variable region | B6 | U.S. Pat. No. 8,222,002 SEQ ID NO: 71 | 3670 |
| AD383 | amyloid β peptide | Heavy chain variable region | F10 | U.S. Pat. No. 8,222,002 SEQ ID NO: 81 | 3671 |
| AD384 | amyloid β peptide | Heavy chain variable region | D1 | U.S. Pat. No. 8,222,002 SEQ ID NO: 91 | 3672 |
| AD385 | ApoE-CTD | Heavy chain variable region | 807B-M0001-B07 | WO2005051998 SEQ ID NO: 135 | 3673 |
| AD386 | ApoE-CTD | Heavy chain variable region | 807B-M0004-A03 | WO2005051998 SEQ ID NO: 136 | 3674 |
| AD387 | ApoE-CTD | Heavy chain variable region | 807B-M0004-A05 | WO2005051998 SEQ ID NO: 137 | 3675 |
| AD388 | ApoE-CTD | Heavy chain variable region | 807B-M0004-C04 | WO2005051998 SEQ ID NO: 138 | 3676 |
| AD389 | ApoE-CTD | Heavy chain variable region | 807B-M0004-C05 | WO2005051998 SEQ ID NO: 139 | 3677 |
| AD390 | ApoE-CTD | Heavy chain variable region | 807B-M0004-F06 | WO2005051998 SEQ ID NO: 140 | 3678 |

TABLE 4-continued

Alzheimer's Disease Antibodies

| Antibody No. | Target | Description | Antibody Name | Reference Information | SEQ ID NO |
|---|---|---|---|---|---|
| AD391 | ApoE-CTD | Heavy chain variable region | 807B-M0004-F10 | WO2005051998 SEQ ID NO: 141 | 3679 |
| AD392 | ApoE-CTD | Heavy chain variable region | 807B-M0004-H03 | WO2005051998 SEQ ID NO: 142 | 3680 |
| AD393 | ApoE-CTD | Heavy chain variable region | 807B-M0009-C03 | WO2005051998 SEQ ID NO: 143 | 3681 |
| AD394 | ApoE-CTD | Heavy chain variable region | 807B-M0009-F06 | WO2005051998 SEQ ID NO: 144 | 3682 |
| AD395 | ApoE-CTD | Heavy chain variable region | 807B-M0013-A12 | WO2005051998 SEQ ID NO: 145 | 3683 |
| AD396 | ApoE-CTD | Heavy chain variable region | 807B-M0079-D10 | WO2005051998 SEQ ID NO: 146 | 3684 |
| AD397 | ApoE-CTD | Heavy chain variable region | 807B-M0081-F12 | WO2005051998 SEQ ID NO: 147 | 3685 |
| AD398 | ApoE-CTD | Heavy chain variable region | 807B-M0081-H03 | WO2005051998 SEQ ID NO: 148 | 3686 |
| AD399 | ApoE-CTD | Heavy chain variable region | 807B-M0083-E11 | WO2005051998 SEQ ID NO: 149 | 3687 |
| AD400 | ApoE-CTD | Heavy chain variable region | 807A-M0027-E11 | WO2005051998 SEQ ID NO: 39 | 3688 |
| AD401 | ApoE-CTD | Heavy chain variable region | 807A-M0028-B02 | WO2005051998 SEQ ID NO: 40 | 3689 |
| AD402 | ApoE-CTD | Heavy chain variable region | 807A-M0026-F05 | WO2005051998 SEQ ID NO: 41 | 3690 |
| AD403 | APP | Heavy chain variable region | | WO2014151747 SEQ NO 35 | 3691 |
| AD404 | App | Heavy chain variable region | | WO2014151747 SEQ NO 37 | 3692 |
| AD405 | APP | Heavy chain variable region | | WO2014151747 SEQ NO 39 | 3693 |
| AD406 | APP | Heavy chain variable region | | WO2014151747 SEQ NO 41 | 3694 |
| AD407 | APP | Heavy chain variable region | | WO2014151747 SEQ NO 43 | 3695 |
| AD408 | Aβ amyloid | Heavy chain variable region | 15C11 | WO2006066049 SEQ ID NO: 4 | 3696 |
| AD409 | Aβ amyloid | Heavy chain variable region | 9G8 | WO2006066049 SEQ ID NO: 5 | 3697 |
| AD410 | Aβ amyloid | Heavy chain variable region | 266 | WO2006066049 SEQ ID NO: 6 | 3698 |
| AD411 | Aβ amyloid | Heavy chain variable region | 12A1 1 v1 | WO2006066089 SEQ ID NO: 10 | 3699 |
| AD412 | Aβ amyloid | Heavy chain variable region | v2 | WO2006066089 SEQ ID NO: 13 | 3700 |
| AD413 | Aβ amyloid | Heavy chain variable region | v2.1 | WO2006066089 SEQ ID NO: 14 | 3701 |
| AD414 | Aβ amyloid | Heavy chain variable region | v3 | WO2006066089 SEQ ID NO: 15 | 3702 |
| AD415 | Aβ amyloid | Heavy chain variable region | v4.1 | WO2006066089 SEQ ID NO: 16 | 3703 |
| AD416 | Aβ amyloid | Heavy chain variable region | v4.2 | WO2006066089 SEQ ID NO: 17 | 3704 |
| AD417 | Aβ amyloid | Heavy chain variable region | v4.3 | WO2006066089 SEQ ID NO: 18 | 3705 |
| AD418 | Aβ amyloid | Heavy chain variable region | v4.4 | WO2006066089 SEQ ID NO: 19 | 3706 |
| AD419 | Aβ amyloid | Heavy chain variable region | v5.1 | WO2006066089 SEQ ID NO: 20 | 3707 |
| AD420 | Aβ amyloid | Heavy chain variable region | v5.2 | WO2006066089 SEQ ID NO: 21 | 3708 |
| AD421 | Aβ amyloid | Heavy chain variable region | v5.3 | WO2006066089 SEQ ID NO: 22 | 3709 |
| AD422 | Aβ amyloid | Heavy chain variable region | v5.4 | WO2006066089 SEQ ID NO: 23 | 3710 |
| AD423 | Aβ amyloid | Heavy chain variable region | v5.5 | WO2006066089 SEQ ID NO: 24 | 3711 |
| AD424 | Aβ amyloid | Heavy chain variable region | v5.5 | WO2006066089 SEQ ID NO: 25 | 3712 |
| AD425 | Aβ amyloid | Heavy chain variable region | v6.1 | WO2006066089 SEQ ID NO: 26 | 3713 |
| AD426 | Aβ amyloid | Heavy chain variable region | v6.2 | WO2006066089 SEQ ID NO: 27 | 3714 |
| AD427 | Aβ amyloid | Heavy chain variable region | v6.1 | WO2006066089 SEQ ID NO: 28 | 3715 |

TABLE 4-continued

Alzheimer's Disease Antibodies

| Antibody No. | Target | Description | Antibody Name | Reference Information | SEQ ID NO |
|---|---|---|---|---|---|
| AD428 | Aβ amyloid | Heavy chain variable region | v6.2 | WO2006066089 SEQ ID NO: 29 | 3716 |
| AD429 | Aβ amyloid | Heavy chain variable region | v7 | WO2006066089 SEQ ID NO: 30 | 3717 |
| AD430 | Aβ amyloid | Heavy chain variable region | v8 | WO2006066089 SEQ ID NO: 31 | 3718 |
| AD431 | Aβ amyloid | Heavy chain variable region | v3.1 | WO2006066089 SEQ ID NO: 36 | 3719 |
| AD432 | Aβ amyloid | Heavy chain variable region | GenBank BAC01733 | WO2006066089 SEQ ID NO: 8 | 3720 |
| AD433 | Aβ amyloid | Heavy chain variable region | A19 | WO2006066089 SEQ ID NO: 9 | 3721 |
| AD434 | Aβ amyloids | Heavy chain variable region | Humanized 3D6 (Bapineuzumab) | U.S. Pat. No. 8,784,810 SEQ ID NO: 2 | 3722 |
| AD435 | Aβ amyloids | Heavy chain variable region | Humanized 10D5 | U.S. Pat. No. 8,784,810 SEQ ID NO: 29 | 3723 |
| AD436 | Aβ amyloids | Heavy chain variable region | Humanized 3D6 (Bapineuzumab), version 2 | U.S. Pat. No. 8,784,810 SEQ ID NO: 4 | 3724 |
| AD437 | Aβ amyloids | Heavy chain variable region | Humanized 12A11 | U.S. Pat. No. 8,784,810 SEQ ID NO: 8 | 3725 |
| AD438 | Aβ peptide | Heavy chain variable region | | U.S. Pat. No. 8,066,999 SEQ ID NO: 2 | 3726 |
| AD439 | Aβ peptide | Heavy chain variable region | | U.S. Pat. No. 8,066,999 SEQ ID NO: 3 | 3727 |
| AD440 | Aβ polypeptide | Heavy chain variable region | preferred embodiment 6, 11, 12 | WO2008084402 SEQ ID NO: 148 | 3728 |
| AD441 | Aβ polypeptide | Heavy chain variable region | | WO2008084402 SEQ ID NO: 57 | 3729 |
| AD442 | Aβ polypeptide | Heavy chain variable region | | WO2008084402 SEQ ID NO: 58 | 3730 |
| AD443 | Aβ polypeptide | Heavy chain variable region | | WO2008084402 SEQ ID NO: 59 | 3731 |
| AD444 | Aβ polypeptide | Heavy chain variable region | preferred embodiment 1, 2, 3, 4, 5, 9 | WO2008084402 SEQ ID NO: 60 | 3732 |
| AD445 | Aβ polypeptide | Heavy chain variable region | preferred embodiment 7, 10, 13 | WO2008084402 SEQ ID NO: 61 | 3733 |
| AD446 | Aβ polypeptide | Heavy chain variable region | preferred embodiment 8 | WO2008084402 SEQ ID NO: 62 | 3734 |
| AD447 | Aβ polypeptide | Heavy chain variable region | | WO2008084402 SEQ ID NO: 63 | 3735 |
| AD448 | Aβ polypeptide | Heavy chain variable region | | WO2008084402 SEQ ID NO: 64 | 3736 |
| AD449 | Aβ polypeptide | Heavy chain variable region | | WO2008084402 SEQ ID NO: 65 | 3737 |
| AD450 | Aβ polypeptide | Heavy chain variable region | | WO2008084402 SEQ ID NO: 66 | 3738 |
| AD451 | Aβ polypeptide | Heavy chain variable region | | WO2008084402 SEQ ID NO: 67 | 3739 |
| AD452 | Aβ polypeptide | Heavy chain variable region | | WO2008084402 SEQ ID NO: 68 | 3740 |
| AD453 | Aβ polypeptide | Heavy chain variable region | | WO2008084402 SEQ ID NO: 69 | 3741 |
| AD454 | Aβ polypeptide | Heavy chain variable region | | WO2008084402 SEQ ID NO: 70 | 3742 |
| AD455 | Aβ polypeptide | Heavy chain variable region | | WO2008084402 SEQ ID NO: 71 | 3743 |
| AD456 | beta A4 peptide/Alpha beta 4 | Heavy chain variable region | Antibody A | WO2007068429 SEQ ID NO: 2 | 3744 |
| AD457 | beta amyloid | Heavy chain variable region | Kabat ID 000333 | U.S. Pat. No. 7,256,273 SEQ ID NO: 34 | 3745 |
| AD458 | beta amyloid | Heavy chain variable region | Germline VH4-6 | U.S. Pat. No. 7,256,273 SEQ ID NO: 36 | 3746 |
| AD459 | beta amyloid | Heavy chain variable region | Germline VH4-6 | U.S. Pat. No. 7,256,273 SEQ ID NO: 38 | 3747 |
| AD460 | beta amyloid | Heavy chain variable region | 12B4 | U.S. Pat. No. 7,256,273 SEQ ID NO: 4 | 3748 |
| AD461 | beta amyloid | Heavy chain variable region | humanized 12B4 | U.S. Pat. No. 7,256,273 SEQ ID NO: 8 | 3749 |
| AD462 | beta amyloid | Heavy chain variable region | ESBA212 | U.S. Pat. No. 8,323,647 SEQ ID NO: 17 | 3750 |
| AD463 | beta amyloid | Heavy chain variable region | Framework 2.3 | U.S. Pat. No. 8,323,647 SEQ ID NO: 18 | 3751 |

TABLE 4-continued

Alzheimer's Disease Antibodies

| Antibody No. | Target | Description | Antibody Name | Reference Information | SEQ ID NO |
|---|---|---|---|---|---|
| AD464 | beta amyloid | Heavy chain variable region | 22C4 | U.S. Pat. No. 8,323,647 SEQ ID NO: 19 | 3752 |
| AD465 | beta amyloid | Heavy chain variable region | VH H | U.S. Pat. No. 8,323,647 SEQ ID NO: 20 | 3753 |
| AD466 | beta amyloid | Heavy chain variable region | VH I | U.S. Pat. No. 8,323,647 SEQ ID NO: 21 | 3754 |
| AD467 | beta amyloid | Heavy chain variable region | VH J | U.S. Pat. No. 8,323,647 SEQ ID NO: 22 | 3755 |
| AD468 | beta amyloid | Heavy chain variable region | VH K | U.S. Pat. No. 8,323,647 SEQ ID NO: 23 | 3756 |
| AD469 | beta amyloid | Heavy chain variable region | | U.S. Pat. No. 10/476,265 SEQ ID NO: 10 | 3757 |
| AD470 | beta amyloid | Heavy chain variable region | | U.S. Pat. No. 10/476,265 SEQ ID NO: 11 | 3758 |
| AD471 | beta amyloid | Heavy chain variable region | | U.S. Pat. No. 10/476,265 SEQ ID NO: 12 | 3759 |
| AD472 | beta amyloid | Heavy chain variable region | ACI-12-Ab-11 | US20140199323 SEQ ID NO: 10 | 3760 |
| AD473 | beta amyloid | Heavy chain variable region | ACI-11-Ab-9 | US20140199323 SEQ ID NO: 8 | 3761 |
| AD474 | beta amyloid | Heavy chain variable region | 8C5 | US20150071915 SEQ ID NO: 19 | 3762 |
| AD475 | beta amyloid | Heavy chain variable region | 8F5 | US20150071915 SEQ ID NO: 3 | 3763 |
| AD476 | beta amyloid | Heavy chain variable region | germline VH3-23 | U.S. Pat. No. 7,189,819 SEQ ID NO: 10 | 3764 |
| AD477 | beta amyloid | Heavy chain variable region | | U.S. Pat. No. 7,189,819 SEQ ID NO: 12 | 3765 |
| AD478 | beta amyloid | Heavy chain variable region | 10D5 | U.S. Pat. No. 7,189,819 SEQ ID NO: 16 | 3766 |
| AD479 | beta amyloid | Heavy chain variable region | m3D6 | U.S. Pat. No. 7,189,819 SEQ ID NO: 4 | 3767 |
| AD480 | beta amyloid | Heavy chain variable region | humanized 3D6 | U.S. Pat. No. 7,189,819 SEQ ID NO: 8 | 3768 |
| AD481 | beta amyloid | Heavy chain variable region | Kabat ID 109230 | U.S. Pat. No. 7,189,819 SEQ ID NO: 9 | 3769 |
| AD482 | beta amyloid | Heavy chain variable region | Bapineuzumab, AAB-001 | U.S. Pat. No. 8,613,920 SEQ ID NO: 2 | 3770 |
| AD483 | beta amyloid peptide | Heavy chain variable region | M99675 | WO2007113172 SEQ ID NO: 21 | 3771 |
| AD484 | beta amyloid peptide | Heavy chain variable region | Humanized H1 | WO2007113172 SEQ ID NO: 26 | 3772 |
| AD485 | beta amyloid peptide | Heavy chain variable region | Humanized H2 | WO2007113172 SEQ ID NO: 28 | 3773 |
| AD486 | beta amyloid peptide | Heavy chain variable region | Humanized H3 | WO2007113172 SEQ ID NO: 30 | 3774 |
| AD487 | BETA-AMYLOID | Heavy chain variable region | NI-101.12 | WO2008081008 SEQ ID NO: 10 | 3775 |
| AD488 | BETA-AMYLOID | Heavy chain variable region | NI-101.13 | WO2008081008 SEQ ID NO: 14 | 3776 |
| AD489 | BETA-AMYLOID | Heavy chain variable region | NI-101.12F6A | WO2008081008 SEQ ID NO: 39 | 3777 |
| AD490 | BETA-AMYLOID | Heavy chain variable region | NI-101.10 | WO2008081008 SEQ ID NO: 4 | 3778 |
| AD491 | BETA-AMYLOID | Heavy chain variable region | NI-101.13A | WO2008081008 SEQ ID NO: 42 | 3779 |
| AD492 | BETA-AMYLOID | Heavy chain variable region | NI-101.13A | WO2008081008 SEQ ID NO: 44 | 3780 |
| AD493 | BETA-AMYLOID | Heavy chain variable region | NI-101.11 | WO2008081008 SEQ ID NO: 6 | 3781 |
| AD494 | DR6 and P75 | Heavy chain variable region | IP1D6.3 | WO2010062904 SEQ ID NO: 107 | 3116 |
| AD495 | DR6 and P75 | Heavy chain variable region | IP2F2.1 | WO2010062904 SEQ ID NO: 117 | 3117 |
| AD496 | DR6 and P75 | Heavy chain variable region | IP5D10.2 | WO2010062904 SEQ ID NO: 127 | 3118 |
| AD497 | DR6 and P75 | Heavy chain variable region | M51-H09 | WO2010062904 SEQ ID NO: 17 | 3119 |
| AD498 | DR6 and P75 | Heavy chain variable region | M53-E04 | WO2010062904 SEQ ID NO: 27 | 3120 |
| AD499 | DR6 and P75 | Heavy chain variable region | M53-F04 | WO2010062904 SEQ ID NO: 37 | 3121 |
| AD500 | DR6 and P75 | Heavy chain variable region | M62-B02 | WO2010062904 SEQ ID NO: 47 | 3122 |

TABLE 4-continued

Alzheimer's Disease Antibodies

| Antibody No. | Target | Description | Antibody Name | Reference Information | SEQ ID NO |
|---|---|---|---|---|---|
| AD501 | DR6 and P75 | Heavy chain variable region | M63-E10 | WO2010062904 SEQ ID NO: 57 | 3123 |
| AD502 | DR6 and P75 | Heavy chain variable region | M66-B03 | WO2010062904 SEQ ID NO: 67 | 3111 |
| AD503 | DR6 and P75 | Heavy chain variable region | M50-H01 | WO2010062904 SEQ ID NO: 7 | 3112 |
| AD504 | DR6 and P75 | Heavy chain variable region | M67-G02 | WO2010062904 SEQ ID NO: 77 | 3113 |
| AD505 | DR6 and P75 | Heavy chain variable region | M77-F03 | WO2010062904 SEQ ID NO: 87 | 3114 |
| AD506 | DR6 and P75 | Heavy chain variable region | M73-C04 | WO2010062904 SEQ ID NO: 97 | 3115 |
| AD507 | IOD5 | Heavy chain variable region | | WO2002088307 SEQ ID NO: 10 | 3782 |
| AD508 | IOD5 | Heavy chain variable region | | WO2002088307 SEQ ID NO: 12 | 3783 |
| AD509 | IOD5 | Heavy chain variable region | | WO2002088307 SEQ ID NO: 8 | 3784 |
| AD510 | LPG (lysophosphatidylglucoside) | Heavy chain variable region | #7 | U.S. Pat. No. 8,591,902 SEQ ID NO: 18 | 3124 |
| AD511 | LPG (lysophosphatidylglucoside) | Heavy chain variable region | #15 | U.S. Pat. No. 8,591,902 SEQ ID NO: 8 | 3125 |
| AD512 | MAG | Heavy chain variable region | | U.S. Pat. No. 8,071,731 SEQ ID NO: 13 | 3126 |
| AD513 | MAG | Heavy chain variable region | | U.S. Pat. No. 8,071,731 SEQ ID NO: 14 | 3127 |
| AD514 | MAG | Heavy chain variable region | | U.S. Pat. No. 8,071,731 SEQ ID NO: 15 | 3128 |
| AD515 | MAI (myelin associated inhibitor) | Heavy chain variable region | | WO2013158748 SEQ ID NO: 1 | 3129 |
| AD516 | MAI (myelin associated inhibitor) | Heavy chain variable region | | WO2013158748 SEQ ID NO: 17 | 3130 |
| AD517 | NMDA | Heavy chain variable region | | EP2805972 SEQ ID NO: 43 | 3131 |
| AD518 | NOGO | Heavy chain variable region | H5L13, H5L16, H5L18, H5L14, H5L15, H5L17, H5L6, H5L11 | US20140147435 SEQ ID NO: 11 | 3132 |
| AD519 | NOGO | Heavy chain variable region | H6L13, H6L16, H6L18, H6L14, H6L15, H6L17, H6L6 | US20140147435 SEQ ID NO: 12 | 3133 |
| AD520 | NOGO | Heavy chain variable region | H700L13, H700L16, H700L18, H700L14, H700L15, H700L17, H700L6, H700L11 | US20140147435 SEQ ID NO: 13 | 3134 |
| AD521 | NOGO | Heavy chain variable region | H14L13, H14L16, H14L18, H14L14, H14L15, H14L17, H14L6, H14L11 | US20140147435 SEQ ID NO: 14 | 3135 |
| AD522 | NOGO | Heavy chain variable region | H15L13, H15L16, H15L18, H15L14, H15L15, H15L17, H15L6, H15L11 | US20140147435 SEQ ID NO: 15 | 3136 |
| AD523 | NOGO | Heavy chain variable region | H16L13, H16L16, H16L18, H16L14, H16L15, H16L17, H16L6, H16L11 | US20140147435 SEQ ID NO: 16 | 3137 |
| AD524 | NOGO | Heavy chain variable region | H17L13, H17L16, H17L18, H17L14, H17L15, H17L17, H17L6, H17L11 | US20140147435 SEQ ID NO: 17 | 3138 |
| AD525 | NOGO | Heavy chain variable region | H18L13, H18L16, H18L18, H18L14, H18L15, H18L17, H18L6, H18L11 | US20140147435 SEQ ID NO: 18 | 3139 |
| AD526 | NOGO | Heavy chain variable region | H1L13, H1L16, H1L18, H1L14, H1L15, H1L17, H1L6 | US20140147435 SEQ ID NO: 77 | 3140 |
| AD527 | NOGO | Heavy chain variable region | H19L13, H19L16, H19L18, H19L14, H19L15, H19L17, H19L6, H19L11 | US20140147435 SEQ ID NO: 85 | 3141 |

TABLE 4-continued

Alzheimer's Disease Antibodies

| Antibody No. | Target | Description | Antibody Name | Reference Information | SEQ ID NO |
|---|---|---|---|---|---|
| AD528 | NOGO | Heavy chain variable region | H20L13, H20L16, H20L18, H20L14, H20L15, H20L17, H20L6, H20L11 | US20140147435 SEQ ID NO: 86 | 3142 |
| AD529 | NOGO | Heavy chain variable region | H21L13, H21L16, H21L18, H21L14, H21L15, H21L17, H21L6, H21L11 | US20140147435 SEQ ID NO: 87 | 3143 |
| AD530 | NOGO | Heavy chain variable region | H22L13, H22L16, H22L18, H22L14, H22L15, H22L17, H22L6, H22L11 | US20140147435 SEQ ID NO: 88 | 3144 |
| AD531 | NOGO | Heavy chain variable region | H23L13, H23L16, H23L18, H23L14, H23L15, H23L17, H23L6, H23L11 | US20140147435 SEQ ID NO: 89 | 3145 |
| AD532 | NOGO | Heavy chain variable region | H24L13, H24L16, H24L18, H24L14, H24L15, H24L17, H24L6, H24L11 | US20140147435 SEQ ID NO: 90 | 3146 |
| AD533 | NOGO | Heavy chain variable region | H25L13, H25L16, H25L18, H25L14, H25L15, H25L17, H25L6, H25L11 | US20140147435 SEQ ID NO: 91 | 3147 |
| AD534 | Nogo-66 | Heavy chain variable region | Antibody clone 50 | US20140065155 SEQ ID NO: 3 | 3148 |
| AD535 | Nogo-66 | Heavy chain variable region | Antibody clone 51 | US20140065155 SEQ ID NO: 5 | 3149 |
| AD536 | NogoA/NiG | Heavy chain variable region | 6A3-Ig4 | WO2009056509 SEQ ID NO: 24 | 3150 |
| AD537 | NogoA/NiG | Heavy chain variable region | 6A3-IgG1 | WO2009056509 SEQ ID NO: 4 | 3151 |
| AD538 | N-terminal region of Aβ8-x peptide | Heavy chain variable region | Antibody Tea 1.1 (Secreted by Hybridoma IGH525) | US20110059092 SEQ ID NO: 10 | 3785 |
| AD539 | N-terminal region of Aβ8-x peptide | Heavy chain variable region | Antibody TeiA 1.6 (Secreted by Hybridoma IGH521) | US20110059092 SEQ ID NO: 2 | 3786 |
| AD540 | N-terminal region of Aβ8-x peptide | Heavy chain variable region | Antibody TeiA 1.7 (Secreted by Hybridoma IGH522) | US20110059092 SEQ ID NO: 4 | 3787 |
| AD541 | N-terminal region of Aβ8-x peptide | Heavy chain variable region | Antibody TeiA 1.8 (Secreted by Hybridoma IGH523) | US20110059092 SEQ ID NO: 6 | 3788 |
| AD542 | N-terminal region of Aβ8-x peptide | Heavy chain variable region | Antibody TeiA 2b.6 (Secreted by Hybridoma IGH524) | US20110059092 SEQ ID NO: 8 | 3789 |
| AD543 | oligomers of N-terminal truncated Aβ | Heavy chain variable region | 9D5 | U.S. Pat. No. 8,795,664 SEQ ID NO: 26 | 3790 |
| AD544 | oligomers of N-terminal truncated Aβ | Heavy chain variable region | 8C4 | U.S. Pat. No. 8,795,664 SEQ ID NO: 30 | 3791 |
| AD545 | PrP | Heavy chain variable region | ICSM18VH | US20140294844 SEQ ID NO: 4 | 3792 |
| AD546 | PrPC and/or PrPSc | Heavy chain variable region | | US20150166668 SEQ ID NO: 8 | 3793 |
| AD547 | pyroglutamated Aβ | Heavy chain variable region | | WO2012136552 SEQ ID NO: 25 | 3794 |
| AD548 | pyroglutamated Aβ | Heavy chain variable region | | WO2012136552 SEQ ID NO: 29 | 3795 |
| AD549 | pyroglutamated Aβ | Heavy chain variable region | | WO2012136552 SEQ ID NO: 5 | 3796 |
| AD550 | pyroglutamated Aβ | Heavy chain variable region | | WO2012136552 SEQ ID NO: 9 | 3797 |
| AD551 | RGM A | Heavy chain variable region | 5F9.1-GL | US20150183871 SEQ ID NO: 35 | 3152 |
| AD552 | RGM A | Heavy chain variable region | 5F9.2-GL | US20150183871 SEQ ID NO: 36 | 3153 |
| AD553 | RGM A | Heavy chain variable region | 5F9.3-GL | US20150183871 SEQ ID NO: 37 | 3154 |
| AD554 | RGM A | Heavy chain variable region | 5F9.4-GL | US20150183871 SEQ ID NO: 38 | 3155 |
| AD555 | RGM A | Heavy chain variable region | 5F9.5-GL | US20150183871 SEQ ID NO: 39 | 3156 |

TABLE 4-continued

Alzheimer's Disease Antibodies

| Antibody No. | Target | Description | Antibody Name | Reference Information | SEQ ID NO |
|---|---|---|---|---|---|
| AD556 | RGM A | Heavy chain variable region | 5F9.6-GL | US20150183871 SEQ ID NO: 40 | 3157 |
| AD557 | RGM A | Heavy chain variable region | 5F9.7-GL | US20150183871 SEQ ID NO: 41 | 3158 |
| AD558 | RGM A | Heavy chain variable region | 5F9.8-GL | US20150183871 SEQ ID NO: 42 | 3159 |
| AD559 | RGM A | Heavy chain variable region | 5F9.9-GL | US20150183871 SEQ ID NO: 43 | 3160 |
| AD560 | RGM A | Heavy chain variable region | h5F9.1, h5F9.1, h5F9.1, h5F9.1, h5F9.1, h5F9.2, h5F9.3 | US20150183871 SEQ ID NO: 47 | 3161 |
| AD561 | RGM A | Heavy chain variable region | h5F9.3, h5F9.9, h5F9.25 | US20150183871 SEQ ID NO: 53 | 3162 |
| AD562 | RGM A | Heavy chain variable region | h5F9.4, h5F9.10, h5F9.26 | US20150183871 SEQ ID NO: 54 | 3163 |
| AD563 | RGMa | Heavy chain variable region | AE12-1 | US20140023659 SEQ ID NO: 1 | 3164 |
| AD564 | RGMa | Heavy chain variable region | AE12-20 | US20140023659 SEQ ID NO: 107 | 3165 |
| AD565 | RGMa | Heavy chain variable region | AE12-21 | US20140023659 SEQ ID NO: 115 | 3166 |
| AD566 | RGMa | Heavy chain variable region | AE12-23 | US20140023659 SEQ ID NO: 123 | 3167 |
| AD567 | RGMa | Heavy chain variable region | AE12-24 | US20140023659 SEQ ID NO: 131 | 3168 |
| AD568 | RGMa | Heavy chain variable region | AE12-3 | US20140023659 SEQ ID NO: 17 | 3169 |
| AD569 | RGMa | Heavy chain variable region | AE12-4 | US20140023659 SEQ ID NO: 25 | 3170 |
| AD570 | RGMa | Heavy chain variable region | AE12-5 | US20140023659 SEQ ID NO: 33 | 3171 |
| AD571 | RGMa | Heavy chain variable region | AE12-6 | US20140023659 SEQ ID NO: 41 | 3172 |
| AD572 | RGMa | Heavy chain variable region | AE12-7 | US20140023659 SEQ ID NO: 49 | 3173 |
| AD573 | RGMa | Heavy chain variable region | AE12-8 | US20140023659 SEQ ID NO: 57 | 3174 |
| AD574 | RGMa | Heavy chain variable region | AE12-2 | US20140023659 SEQ ID NO: 9 | 3175 |
| AD575 | RGMa | Heavy chain variable region | AE12-13 | US20140023659 SEQ ID NO: 91 | 3176 |
| AD576 | RGMa | Heavy chain variable region | AE12-15 | US20140023659 SEQ ID NO: 99 | 3177 |
| AD577 | tau | Heavy chain variable region | | WO2014100600 SEQ ID NO: 45 | 3798 |
| AD578 | tau | Heavy chain variable region | NI-105.24B2 | US20150252102 SEQ ID NO: 13 | 3799 |
| AD579 | tau | Heavy chain variable region | NI-105.4A3 | US20150252102 SEQ ID NO: 17 | 3800 |
| AD580 | tau | Heavy chain variable region | NI-105.4E4 | US20150252102 SEQ ID NO: 9 | 3801 |
| AD581 | tau | Heavy chain variable region | | WO2013041962 SEQ ID NO: 138 | 3802 |
| AD582 | tau | Heavy chain variable region | | WO2013041962 SEQ ID NO: 139 | 3803 |
| AD583 | tau | Heavy chain variable region | | WO2013041962 SEQ ID NO: 140 | 3804 |
| AD584 | tau | Heavy chain variable region | | WO2013041962 SEQ ID NO: 145 | 3805 |
| AD585 | tau | Heavy chain variable region | | WO2013041962 SEQ ID NO: 147 | 3806 |
| AD586 | tau | Heavy chain variable region | | WO2013041962 SEQ ID NO: 148 | 3807 |
| AD587 | tau | Heavy chain variable region | | WO2014100600 SEQ ID NO: 220 | 3808 |
| AD588 | tau | Heavy chain variable region | NI-105.17C1 | WO2014100600 SEQ ID NO: 44 | 3809 |
| AD589 | tau | Heavy chain variable region | | WO2014100600 SEQ ID NO: 47 | 3810 |
| AD590 | tau | Heavy chain variable region | NI-105.6C5 | WO2014100600 SEQ ID NO: 48 | 3811 |
| AD591 | tau | Heavy chain variable region | NI-105.29G10 | WO2014100600 SEQ ID NO: 50 | 3812 |

TABLE 4-continued

Alzheimer's Disease Antibodies

| Antibody No. | Target | Description | Antibody Name | Reference Information | SEQ ID NO |
|---|---|---|---|---|---|
| AD592 | tau | Heavy chain variable region | NI-105.6L9 | WO2014100600 SEQ ID NO: 52 | 3813 |
| AD593 | tau | Heavy chain variable region | NI-105.40E8 | WO2014100600 SEQ ID NO: 54 | 3814 |
| AD594 | tau | Heavy chain variable region | NI-105.48E5 | WO2014100600 SEQ ID NO: 56 | 3815 |
| AD595 | tau | Heavy chain variable region | NI-105.6E3 | WO2014100600 SEQ ID NO: 58 | 3816 |
| AD596 | tau | Heavy chain variable region | NI-105.22E1 | WO2014100600 SEQ ID NO: 60 | 3817 |
| AD597 | tau | Heavy chain variable region | NI-105.26B12 | WO2014100600 SEQ ID NO: 62 | 3818 |
| AD598 | tau | Heavy chain variable region | NI-105.12E12 | WO2014100600 SEQ ID NO: 65 | 3819 |
| AD599 | tau | Heavy chain variable region | NI-105.60E7 | WO2014100600 SEQ ID NO: 67 | 3820 |
| AD600 | tau | Heavy chain variable region | NI-105.14E2 | WO2014100600 SEQ ID NO: 69 | 3821 |
| AD601 | tau | Heavy chain variable region | NI-105.39E2 | WO2014100600 SEQ ID NO: 71 | 3822 |
| AD602 | tau | Heavy chain variable region | NI-105.19C6 | WO2014100600 SEQ ID NO: 73 | 3823 |
| AD603 | tau | Heavy chain variable region | | WO2014100600 SEQ ID NO: 75 | 3824 |
| AD604 | tau | Heavy chain variable region | NI-105.9C4 | WO2014100600 SEQ ID NO: 76 | 3825 |
| AD605 | tau | Heavy chain variable region | IPN002 variant 1 | U.S. Pat. No. 8,926,974 SEQ ID NO: 36 | 3826 |
| AD606 | tau | Heavy chain variable region | IPN002 variant 2 | U.S. Pat. No. 8,926,974 SEQ ID NO: 37 | 3827 |
| AD607 | tau | Heavy chain variable region | IPN002 variant 3 | U.S. Pat. No. 8,926,974 SEQ ID NO: 38 | 3828 |
| AD608 | tau | Heavy chain variable region | IPN002 variant 4 | U.S. Pat. No. 8,926,974 SEQ ID NO: 39 | 3829 |
| AD609 | tau | Heavy chain variable region | PT1 | US20150307600 SEQ ID NO: 35 | 3830 |
| AD610 | tau | Heavy chain variable region | PT3 | US20150307600 SEQ ID NO: 37 | 3831 |
| AD611 | tau | Heavy chain variable region | | U.S. Pat. No. 9,304,138 SEQ ID NO: 1 | 3832 |
| AD612 | tau | Heavy chain variable region | | U.S. Pat. No. 9,304,138 SEQ ID NO: 2 | 3833 |
| AD613 | tau | Heavy chain variable region | | U.S. Pat. No. 9,304,138 SEQ ID NO: 3 | 3834 |
| AD614 | tau | Heavy chain variable region | | U.S. Pat. No. 9,304,138 SEQ ID NO: 4 | 3835 |
| AD615 | tau | Heavy chain variable region | | U.S. Pat. No. 9,304,138 SEQ ID NO: 5 | 3836 |
| AD616 | tau | Heavy chain variable region | | U.S. Pat. No. 9,304,138 SEQ ID NO: 68 | 3837 |
| AD617 | tau | Heavy chain variable region | | U.S. Pat. No. 9,304,138 SEQ ID NO: 76 | 3838 |
| AD618 | tau | Heavy chain variable region | | U.S. Pat. No. 9,304,138 SEQ ID NO: 88 | 3839 |
| AD619 | tau | Heavy chain variable region | | U.S. Pat. No. 9,304,138 SEQ ID NO: 96 | 3840 |
| AD620 | tau | Heavy chain variable region | | U.S. Pat. No. 9,304,138 SEQ ID NO: 104 | 3841 |
| AD621 | tau | Heavy chain variable region | hAC1-36-3A8-Ab1 and hAC1-36-2B6-Ab1 | US20150175682 SEQ ID NO: 7 | 3842 |
| AD622 | tau | Heavy chain variable region | hAC1-36-3A8-Ab1.v2. | US20150175682 SEQ ID NO: 20 | 3843 |
| AD623 | tau | Heavy chain variable region | hAC1-36-2B6-Ab1.v2 | US20150175682 SEQ ID NO: 21 | 3844 |
| AD624 | tau | Heavy chain variable region | ADx210 | US20140161875 SEQ ID NO: 15 | 3845 |
| AD625 | tau | Heavy chain variable region | ADx210 subpart | US20140161875 SEQ ID NO: 17 | 3846 |
| AD626 | tau | Heavy chain variable region | ADx215 | US20140161875 SEQ ID NO: 25 | 3847 |
| AD627 | tau antigen | Heavy chain variable region | ADx202 | WO2015004163 SEQ ID NO: 14 | 3848 |
| AD628 | tau ps 422 | Heavy chain variable region | antibody Mab2.10.3 | US20110059093 SEQ ID NO: 2 | 3849 |

TABLE 4-continued

Alzheimer's Disease Antibodies

| Antibody No. | Target | Description | Antibody Name | Reference Information | SEQ ID NO |
|---|---|---|---|---|---|
| AD629 | tau ps 422 | Heavy chain variable region | Mab 005 | US20110059093 SEQ ID NO: 22 | 3850 |
| AD630 | tau ps 422 | Heavy chain variable region | Mab 019 | US20110059093 SEQ ID NO: 30 | 3851 |
| AD631 | tau ps 422 | Heavy chain variable region | Mab 020 | US20110059093 SEQ ID NO: 38 | 3852 |
| AD632 | tau ps 422 | Heavy chain variable region | Mab 085 | US20110059093 SEQ ID NO: 46 | 3853 |
| AD633 | tau ps 422 | Heavy chain variable region | Mab 086 | US20110059093 SEQ ID NO: 54 | 3854 |
| AD634 | tau ps 422 | Heavy chain variable region | Mab 097 | US20110059093 SEQ ID NO: 62 | 3855 |
| AD635 | TrkA | Heavy chain variable region | HuVHWO | WO2009098238 SEQ ID NO: 17 | 3856 |
| AD636 | NOGO | Heavy chain variable region humanized construct H1 | 2A10 construct | WO2007003421 SEQ ID NO: 77 | 3181 |
| AD637 | NOGO | Heavy chain variable region humanized construct H14 | 2A10 construct | WO2007003421 SEQ ID NO: 14 | 3182 |
| AD638 | NOGO | Heavy chain variable region humanized construct H15 | 2A10 construct | WO2007003421 SEQ ID NO: 15 | 3183 |
| AD639 | NOGO | Heavy chain variable region humanized construct H16 | 2A10 construct | WO2007003421 SEQ ID NO: 16 | 3184 |
| AD640 | NOGO | Heavy chain variable region humanized construct H17 | 2A10 construct | WO2007003421 SEQ ID NO: 17 | 3185 |
| AD641 | NOGO | Heavy chain variable region humanized construct H18 | 2A10 construct | WO2007003421 SEQ ID NO: 18 | 3186 |
| AD642 | NOGO | Heavy chain variable region humanized construct H19 | 2A10 construct | WO2007003421 SEQ ID NO: 85 | 3187 |
| AD643 | NOGO | Heavy chain variable region humanized construct H20 | 2A10 construct | WO2007003421 SEQ ID NO: 86 | 3188 |
| AD644 | NOGO | Heavy chain variable region humanized construct H21 | 2A10 construct | WO2007003421 SEQ ID NO: 87 | 3189 |
| AD645 | NOGO | Heavy chain variable region humanized construct H22 | 2A10 construct | WO2007003421 SEQ ID NO: 88 | 3190 |
| AD646 | NOGO | Heavy chain variable region humanized construct H23 | 2A10 construct | WO2007003421 SEQ ID NO: 89 | 3191 |
| AD647 | NOGO | Heavy chain variable region humanized construct H24 | 2A10 construct | WO2007003421 SEQ ID NO: 90 | 3192 |
| AD648 | NOGO | Heavy chain variable region humanized construct H25 | 2A10 construct | WO2007003421 SEQ ID NO: 91 | 3193 |
| AD649 | NOGO | Heavy chain variable region humanized construct H5 | 2A10 construct | WO2007003421 SEQ ID NO: 11 | 3194 |
| AD650 | NOGO | Heavy chain variable region humanized construct H6 | 2A10 construct | WO2007003421 SEQ ID NO: 12 | 3195 |

TABLE 4-continued

Alzheimer's Disease Antibodies

| Antibody No. | Target | Description | Antibody Name | Reference Information | SEQ ID NO |
|---|---|---|---|---|---|
| AD651 | NOGO | Heavy chain variable region humanized construct H700 | 2A10 construct | WO2007003421 SEQ ID NO: 13 | 3196 |
| AD652 | beta A4 peptide/Alpha beta 8 | Heavy chain with Fc region | Antibody A | WO2007068429 SEQ ID NO: 26 | 3857 |
| AD653 | ACTH | Light chain | Ab3 | WO2015127288 SEQ ID NO: 101 | 3205 |
| AD654 | ACTH | Light chain | Ab4 | WO2015127288 SEQ ID NO: 141 | 3206 |
| AD655 | ACTH | Light chain | Ab5 | WO2015127288 SEQ ID NO: 181 | 3207 |
| AD656 | ACTH | Light chain | Ab1 | WO2015127288 SEQ ID NO: 21 | 3208 |
| AD657 | ACTH | Light chain | Ab6 | WO2015127288 SEQ ID NO: 221 | 3209 |
| AD658 | ACTH | Light chain | Ab7 | WO2015127288 SEQ ID NO: 261 | 3210 |
| AD659 | ACTH | Light chain | Ab9 | WO2015127288 SEQ ID NO: 301 | 3211 |
| AD660 | ACTH | Light chain | Ab10 | WO2015127288 SEQ ID NO: 341 | 3212 |
| AD661 | ACTH | Light chain | Ab11 | WO2015127288 SEQ ID NO: 381 | 3213 |
| AD662 | ACTH | Light chain | Ab12 | WO2015127288 SEQ ID NO: 421 | 3214 |
| AD663 | ACTH | Light chain | Ab1.H | WO2015127288 SEQ ID NO: 461 | 3215 |
| AD664 | ACTH | Light chain | Ab2.H | WO2015127288 SEQ ID NO: 501 | 3216 |
| AD665 | ACTH | Light chain | Ab3.H | WO2015127288 SEQ ID NO: 541 | 3217 |
| AD666 | ACTH | Light chain | Ab4.H | WO2015127288 SEQ ID NO: 581 | 3218 |
| AD667 | ACTH | Light chain | Ab2 | WO2015127288 SEQ ID NO: 61 | 3219 |
| AD668 | ACTH | Light chain | Ab6.H | WO2015127288 SEQ ID NO: 621 | 3220 |
| AD669 | ACTH | Light chain | Ab7.H | WO2015127288 SEQ ID NO: 661 | 3221 |
| AD670 | ACTH | Light chain | Ab7A.H | WO2015127288 SEQ ID NO: 701 | 3222 |
| AD671 | ACTH | Light chain | Ab10.H | WO2015127288 SEQ ID NO: 741 | 3223 |
| AD672 | ACTH | Light chain | Ab11.H | WO2015127288 SEQ ID NO: 781 | 3224 |
| AD673 | ACTH | Light chain | Ab11A.H | WO2015127288 SEQ ID NO: 821 | 3225 |
| AD674 | ACTH | Light chain | Ab12.H | WO20151.27288 SEQ ID NO: 861 | 3226 |
| AD675 | Alpha beta fibril | Light chain | Gantenerumab | Immunogenetics Information System; CHAIN ID NO: 8894_L. | 3858 |
| AD676 | amyloid beta peptide Aβ | Light chain | | U.S. Pat. No. 719,576 SEQ ID NO: 11 | 3859 |
| AD677 | Amyloid beta/BACE1 | Light chain | 3 Fab of Yw412.8.31 | Wang, W. et al. "A Therapeutic Antibody Targeting BACE1 Inhibits Amyloid NO:-{beta}Production in Vivo" Sci Transl Med 3 (84), 84RA43 (2011), NCBI Accession # 3RIG_L (222aa) | 3860 |
| AD678 | amyloid or amyloid-like proteins | Light chain | Humanized C2 | WO2008061796 SEQ ID NO: 2 | 3861 |
| AD679 | amyloid protein | Light chain | C2 | US20100150906 SEQ ID NO: 13 | 3862 |
| AD680 | amyloids | Light chain | #118 | WO2010012004 SEQ ID NO: 10 | 3242 |

TABLE 4-continued

Alzheimer's Disease Antibodies

| Antibody No. | Target | Description | Antibody Name | Reference Information | SEQ ID NO |
|---|---|---|---|---|---|
| AD681 | amyloids | Light chain | #121 | WO2010012004 SEQ ID NO: 12 | 3243 |
| AD682 | amyloids | Light chain | #201 | WO2010012004 SEQ ID NO: 14 | 3244 |
| AD683 | amyloids | Light chain | #204 | WO2010012004 SEQ ID NO: 15 | 3245 |
| AD684 | amyloids | Light chain | #205 | WO2010012004 SEQ ID NO: 17 | 3246 |
| AD685 | APP | Light chain | F5.100 | WO2014151747 SEQ ID NO: | 3863 |
| AD686 | APP | Light chain | BBS1 MAb | WO2014151747 SEQ ID NO: 25 | 3864 |
| AD687 | APP | Light chain | F5.87 | WO2014151747 SEQ ID NO: 27 | 3865 |
| AD688 | APP | Light chain | F5.87 | WO2014151747 SEQ ID NO: 54 | 3866 |
| AD689 | Aβ amyloids | Light chain | Humanized 12A11, version 2 | U.S. Pat. No. 8,784,810 SEQ ID NO: 10 | 3867 |
| AD690 | Aβ amyloids | Light chain | Humanized 3D6 (Bapineuzumab), version 3 | U.S. Pat. No. 8,784,810 SEQ ID NO: 6 | 3868 |
| AD691 | beta A4 peptide/Alpha beta 6 | Light chain | Antibody A | WO2007068429 SEQ ID NO: 8 | 3869 |
| AD692 | beta A4 peptide/Alpha beta 7 | Light chain | Antibody A | WO2007068429 SEQ ID NO: 22 | 3870 |
| AD693 | beta amyloid | Light chain | | U.S. Pat. No. 10/476,265 SEQ ID NO: 19 | 3871 |
| AD694 | beta amyloid | Light chain | | U.S. Pat. No. 13/319,710 SEQ ID NO: 22 | 3872 |
| AD695 | beta amyloid | Light chain | | U.S. Pat. No. 13/319,710 SEQ ID NO: 28 | 3873 |
| AD696 | beta amyloid | Light chain | (13C3) | U.S. Pat. No. 13/319,710 SEQ ID NO: 4 | 3874 |
| AD697 | beta amyloid | Light chain | C2 | US20070166311 SEQ ID NO: 21 | 3875 |
| AD698 | beta amyloid peptide | Light chain | Solanezumab | Immunogenetics Information System; CHAIN ID NO: 9097_L. | 3876 |
| AD699 | beta amyloid peptide | Light chain | Mature L1 | WO2007113172 SEQ ID NO: 40 | 3877 |
| AD700 | beta-amyloid | Light chain | Aducanumab, BIIB0307 | | 3878 |
| AD701 | EAG1 | Light chain | chimeric ImAb3 | WO2006037604 SEQ ID NO: 10 | 3247 |
| AD702 | EAG1 | Light chain | chimeric ImAb4 | WO2006037604 SEQ ID NO: 14 | 3248 |
| AD703 | EAG1 | Light chain | LC-ImAb3-humB3 | WO2006037604 SEQ ID NO: 18 | 3249 |
| AD704 | EAG1 | Light chain | ImAb4 | WO2006037604 SEQ ID NO: 2 | 3250 |
| AD705 | EAG1 | Light chain | LC-ImAb4-humA17 | WO2006037604 SEQ ID NO: 22 | 3251 |
| AD706 | EAG1 | Light chain | LC-ImAb3-humA3 | WO2006037604 SEQ ID NO: 26 | 3252 |
| AD707 | EAG1 | Light chain | LC-ImAb3-humA17 | WO2006037604 SEQ ID NO: 30 | 3253 |
| AD708 | EAG1 | Light chain | LC-ImAb4-humA5-1 | WO2006037604 SEQ ID NO: 34 | 3254 |
| AD709 | EAG1 | Light chain | LC-ImAb4-humO1 | WO2006037604 SEQ ID NO: 38 | 3255 |
| AD710 | EAG1 | Light chain | ImAb3 | WO2006037604 SEQ ID NO: 6 | 3256 |
| AD711 | IGG1 Abeta | Light chain | Humanized C2 | US20090155249 SEQ ID NO: 13 | 3879 |
| AD712 | NOGO | Light chain | H6L13 FL, H19L13 FL, H20L13 FL, H21L13 FL, H25L13 FL | US20140147435 SEQ ID NO: 35 | 3257 |
| AD713 | NOGO | Light chain | H16L16 FL, H19L16 FL, H20L16 FL, H21L16 FL, H25L16 FL, H18L16 FL | US20140147435 SEQ ID NO: 38 | 3258 |

TABLE 4-continued

Alzheimer's Disease Antibodies

| Antibody No. | Target | Description | Antibody Name | Reference Information | SEQ ID NO |
|---|---|---|---|---|---|
| AD714 | NOGO | Light chain | H16L18 FL, H19L18 FL, H20L18 FL, H21L18 FL, H25L18 FL | US20140147435 SEQ ID NO: 40 | 3259 |
| AD715 | Nogo receptor-1 | Light chain | 7E11 | US20090215691 SEQ ID NO: 15 | 3260 |
| AD716 | Nogo receptor-2 | Light chain | 7E11 | US20090215691 SEQ ID NO: 17 | 3261 |
| AD717 | PrPC and/or PrPSc | Light chain | | US20150166668 SEQ ID NO: 9 | 3880 |
| AD718 | PrPC and/or PrPSc | Light chain | | U.S. Pat. No. 8,852,587 SEQ ID NO: 5 | 3881 |
| AD719 | tau | Light chain | hACI-36-3A8 Ab1, hACI-36-3A8 Ab1.v2, hACI-36-3A8 Ab1.v3, hACI-36-3A8 Ab1.v4 | WO2013151762 SEQ ID NO: 22 | 3882 |
| AD720 | tau | Light chain | hACI-36-3B8 Ab1, hACI-36-3B8 Ab1.v2, hACI-36-3B8 Ab1.v3, hACI-36-3B8 Ab1.v4 | WO2013151762 SEQ ID NO: 23 | 3883 |
| AD721 | tau | Light chain | IPN001 | U.S. Pat. No. 8,980,271 SEQ ID NO: 13 | 3884 |
| AD722 | tau | Light chain | IPN002 | U.S. Pat. No. 8,980,271 SEQ ID NO: 15 | 3885 |
| AD723 | tau | Light chain | hACI-36-3A8-Ab1 and hACI-36-2B6-Ab1 | US20150175682 SEQ ID NO: 18 | 3886 |
| AD724 | tau | Light chain | hACI-36-3A8-Ab1 (IgG4), hACI-36-3A8-Ab1.v2 (IgG4), hACI-36-3A8-Ab1.v3 (IgG1), and hACI-36-3A8-Ab1.v4 (IgG1 N297G) | US20150175682 SEQ ID NO: 22 | 3887 |
| AD725 | tau | Light chain | hACI-36-2B6-Ab1 (IgG4), hACI-36-2B6-Ab1.v2 (IgG4), hACI-36-2B6-Ab1.v3 (IgG1), and hACI-36-2B6-Ab1.v4 (IgG1 N297G) | US20150175682 SEQ ID NO: 23 | 3888 |
| AD726 | tau | Light chain | hACI-36-3A8-Ab1 (IgG4) | US20150175682 SEQ ID NO: 24 | 3889 |
| AD727 | TrkA | Light chain | BXhVL4 | WO2009098238 SEQ ID NO: 10 | 3890 |
| AD728 | TrkA | Light chain | BXhVL5 | WO2009098238 SEQ ID NO: 11 | 3891 |
| AD729 | TrkA | Light chain | BXhVLβ | WO2009098238 SEQ ID NO: 12 | 3892 |
| AD730 | TrkA | Light chain | BXhVL7 | WO2009098238 SEQ ID NO: 13 | 3893 |
| AD731 | TrkA | Light chain | BXhVL8 | WO2009098238 SEQ ID NO: 14 | 3894 |
| AD732 | TrkA | Light chain | mVLEP | WO2009098238 SEQ ID NO: 16 | 3895 |
| AD733 | TrkA | Light chain | BXhVL1 | WO2009098238 SEQ ID NO: 7 | 3896 |
| AD734 | TrkA | Light chain | BXhVL2 | WO2009098238 SEQ ID NO: 8 | 3897 |
| AD735 | TrkA | Light chain | BXhVL3 | WO2009098238 SEQ ID NO: 9 | 3898 |
| AD736 | trk-C (NT-3 trkC ligand) | Light chain | 2250 | U.S. Pat. No. 7,615,383 SEQ ID NO: 49 | 3262 |
| AD737 | trk-C (NT-3 trkC ligand) | Light chain | 2253 | U.S. Pat. No. 7,615,383 SEQ ID NO: 50 | 3263 |
| AD738 | trk-C (NT-3 trkC ligand) | Light chain | 2256 | U.S. Pat. No. 7,615,383 SEQ ID NO: 51 | 3264 |
| AD739 | trk-C (NT-3 trkC ligand) | Light chain | 6.1.2 | U.S. Pat. No. 7,615,383 SEQ ID NO: 52 | 3265 |
| AD740 | trk-C (NT-3 trkC ligand) | Light chain | 6.4.1 | U.S. Pat. No. 7,615,383 SEQ ID NO: 53 | 3266 |
| AD741 | trk-C (NT-3 trkC ligand) | Light chain | 2345 | U.S. Pat. No. 7,615,383 SEQ ID NO: 54 | 3267 |
| AD742 | trk-C (NT-3 trkC ligand) | Light chain | 2349 | U.S. Pat. No. 7,615,383 SEQ ID NO: 55 | 3268 |

TABLE 4-continued

Alzheimer's Disease Antibodies

| Antibody No. | Target | Description | Antibody Name | Reference Information | SEQ ID NO |
|---|---|---|---|---|---|
| AD743 | | Light chain | Crenezumab light CHAIN | | 3899 |
| AD744 | | Light chain | Gantenerumab light chain | | 3900 |
| AD745 | | Light chain | Ponezumab light CHAIN | | 3901 |
| AD746 | | Light chain | Solanezumab light CHAIN | | 3902 |
| AD747 | amyloid protein | Light chain constant region | C2 | US20100150906 SEQ ID NO: 14 | 3903 |
| AD748 | IGG1 Abeta | Light Chain constant region | Humanized C2 | US20090155249 SEQ ID NO: 14 | 3904 |
| AD749 | ApoE | Light chain fragment | 2e8 Fab | Trakhanov, S. et al. "Structure of a monoclonal 2E8 Fab antibody fragment specific for the low-density lipoprotein-receptor binding region of apolipoprotein E refined at 1.9 A", Acta Crystallogr. D Biol. Crystallogr. 55 (PT 1), 122-128 (1999), NCBI Accession # 12E8 M | 3905 |
| AD750 | many - growth factors | Light chain fusion protein | H21L13, H21L16, H21L18, H21L14, H21L15, H21L17, H21L6, H21L11 | U.S. Pat. No. 8,053,569 SEQ ID NO: 31 | 3275 |
| AD751 | many - growth factors | Light chain fusion protein | H23L13, H23L16, H23L18, H23L14, H23L15, H23L17, H23L6, H23L11 | U.S. Pat. No. 8,053,569 SEQ ID NO: 36 | 3276 |
| AD752 | NOGO | Light chain humanized construct L11 | 2A10 construct | WO2007003421 SEQ ID NO: 80 | 3277 |
| AD753 | NOGO | Light chain humanized construct L13 | 2A10 construct | WO2007003421 SEQ ID NO: 35 | 3278 |
| AD754 | NOGO | Light chain humanized construct L14 | 2A10 construct | WO2007003421 SEQ ID NO: 36 | 3279 |
| AD755 | NOGO | Light chain humanized construct L15 | 2A10 construct | WO2007003421 SEQ ID NO: 37 | 3280 |
| AD756 | NOGO | Light chain humanized construct L16 | 2A10 construct | WO2007003421 SEQ ID NO: 38 | 3281 |
| AD757 | NOGO | Light chain humanized construct L17 | 2A10 construct | WO2007003421 SEQ ID NO: 39 | 3282 |
| AD758 | NOGO | Light chain humanized construct L18 | 2A10 construct | WO2007003421 SEQ ID NO: 40 | 3283 |
| AD759 | NOGO | Light chain humanized construct L6 | 2A10 construct | WO2007003421 SEQ ID NO: 34 | 3284 |
| AD760 | RTN4 | Light chain IgG4, immunomodulator | Atinumab | U.S. Pat. No. 8,163,285 SEQ ID NO: 25 | 3285 |
| AD761 | tau | Light chain mature | ch4E4 | US20150252102 SEQ ID NO: 21 | 3906 |
| AD762 | A beta oligomers | Light chain variable region | IR-008 | U.S. Pat. No. 8,858,949 SEQ ID NO: 100 | 3907 |
| AD763 | A beta oligomers | Light chain variable region | IR-072 | U.S. Pat. No. 8,858,949 SEQ ID NO: 1012 | 3908 |
| AD764 | A beta oligomers | Light chain variable region | IR-073 | U.S. Pat. No. 8,858,949 SEQ ID NO: 1028 | 3909 |
| AD765 | A beta oligomers | Light chain variable region | IR-074 | U.S. Pat. No. 8,858,949 SEQ ID NO: 1044 | 3910 |
| AD766 | A beta oligomers | Light chain variable region | IR-075 | U.S. Pat. No. 8,858,949 SEQ ID NO: 1060 | 3911 |

TABLE 4-continued

Alzheimer's Disease Antibodies

| Antibody No. | Target | Description | Antibody Name | Reference Information | SEQ ID NO |
|---|---|---|---|---|---|
| AD767 | A beta oligomers | Light chain variable region | IR-076 | U.S. Pat. No. 8,858,949 SEQ ID NO: 1076 | 3912 |
| AD768 | A beta oligomers | Light chain variable region | IR-077 | U.S. Pat. No. 8,858,949 SEQ ID NO: 1092 | 3913 |
| AD769 | A beta oligomers | Light chain variable region | IR-078 | U.S. Pat. No. 8,858,949 SEQ ID NO: 1108 | 3914 |
| AD770 | A beta oligomers | Light chain variable region | IR-079 | U.S. Pat. No. 8,858,949 SEQ ID NO: 1124 | 3915 |
| AD771 | A beta oligomers | Light chain variable region | IR-080 | U.S. Pat. No. 8,858,949 SEQ ID NO: 1140 | 3916 |
| AD772 | A beta oligomers | Light chain variable region | IR-081 | U.S. Pat. No. 8,858,949 SEQ ID NO: 1156 | 3917 |
| AD773 | A beta oligomers | Light chain variable region | IR-011 | U.S. Pat. No. 8,858,949 SEQ ID NO: 116 | 3918 |
| AD774 | A beta oligomers | Light chain variable region | IR-082 | U.S. Pat. No. 8,858,949 SEQ ID NO: 1172 | 3919 |
| AD775 | A beta oligomers | Light chain variable region | IR-083 | U.S. Pat. No. 8,858,949 SEQ ID NO: 1188 | 3920 |
| AD776 | A beta oligomers | Light chain variable region | IR-084 | U.S. Pat. No. 8,858,949 SEQ ID NO: 1204 | 3921 |
| AD777 | A beta oligomers | Light chain variable region | IR-085 | U.S. Pat. No. 8,858,949 SEQ ID NO: 1220 | 3922 |
| AD778 | A beta oligomers | Light chain variable region | IR-086 | U.S. Pat. No. 8,858,949 SEQ ID NO: 1236 | 3923 |
| AD779 | A beta oligomers | Light chain variable region | IR-087 | U.S. Pat. No. 8,858,949 SEQ ID NO: 1252 | 3924 |
| AD780 | A beta oligomers | Light chain variable region | IR-088 | U.S. Pat. No. 8,858,949 SEQ ID NO: 1268 | 3925 |
| AD781 | A beta oligomers | Light chain variable region | IR-089 | U.S. Pat. No. 8,858,949 SEQ ID NO: 1284 | 3926 |
| AD782 | A beta oligomers | Light chain variable region | IR-090 | U.S. Pat. No. 8,858,949 SEQ ID NO: 1300 | 3927 |
| AD783 | A beta oligomers | Light chain variable region | IR-092 | U.S. Pat. No. 8,858,949 SEQ ID NO: 1316 | 3928 |
| AD784 | A beta oligomers | Light chain variable region | IR-012 | U.S. Pat. No. 8,858,949 SEQ ID NO: 132 | 3929 |
| AD785 | A beta oligomers | Light chain variable region | IR-093 | U.S. Pat. No. 8,858,949 SEQ ID NO: 1332 | 3930 |
| AD786 | A beta oligomers | Light chain variable region | IR-094 | U.S. Pat. No. 8,858,949 SEQ ID NO: 1348 | 3931 |
| AD787 | A beta oligomers | Light chain variable region | IR-095 | U.S. Pat. No. 8,858,949 SEQ ID NO: 1364 | 3932 |
| AD788 | A beta oligomers | Light chain variable region | IR-097 | U.S. Pat. No. 8,858,949 SEQ ID NO: 1380 | 3933 |
| AD789 | A beta oligomers | Light chain variable region | IR-098 | U.S. Pat. No. 8,858,949 SEQ ID NO: 1396 | 3934 |
| AD790 | A beta oligomers | Light chain variable region | IR-100 | U.S. Pat. No. 8,858,949 SEQ ID NO: 1412 | 3935 |
| AD791 | A beta oligomers | Light chain variable region | IR-101 | U.S. Pat. No. 8,858,949 SEQ ID NO: 1428 | 3936 |
| AD792 | A beta oligomers | Light chain variable region | IR-102 | U.S. Pat. No. 8,858,949 SEQ ID NO: 1444 | 3937 |
| AD793 | A beta oligomers | Light chain variable region | IR-104 | U.S. Pat. No. 8,858,949 SEQ ID NO: 1460 | 3938 |
| AD794 | A beta oligomers | Light chain variable region | IR-105 | U.S. Pat. No. 8,858,949 SEQ ID NO: 1476 | 3939 |
| AD795 | A beta oligomers | Light chain variable region | IR-013 | U.S. Pat. No. 8,858,949 SEQ ID NO: 148 | 3940 |
| AD796 | A beta oligomers | Light chain variable region | IR-106 | U.S. Pat. No. 8,858,949 SEQ ID NO: 1492 | 3941 |
| AD797 | A beta oligomers | Light chain variable region | IR-107 | U.S. Pat. No. 8,858,949 SEQ ID NO: 1508 | 3942 |
| AD798 | A beta oligomers | Light chain variable region | IR-108 | U.S. Pat. No. 8,858,949 SEQ ID NO: 1524 | 3943 |
| AD799 | A beta oligomers | Light chain variable region | IR-109 | U.S. Pat. No. 8,858,949 SEQ ID NO: 1540 | 3944 |
| AD800 | A beta oligomers | Light chain variable region | IR-110 | U.S. Pat. No. 8,858,949 SEQ ID NO: 1556 | 3945 |
| AD801 | A beta oligomers | Light chain variable region | IR-112 | U.S. Pat. No. 8,858,949 SEQ ID NO: 1572 | 3946 |
| AD802 | A beta oligomers | Light chain variable region | IR-114 | U.S. Pat. No. 8,858,949 SEQ ID NO: 1588 | 3947 |
| AD803 | A beta oligomers | Light chain variable region | IR-115 | U.S. Pat. No. 8,858,949 SEQ ID NO: 1604 | 3948 |

TABLE 4-continued

Alzheimer's Disease Antibodies

| Antibody No. | Target | Description | Antibody Name | Reference Information | SEQ ID NO |
|---|---|---|---|---|---|
| AD804 | A beta oligomers | Light chain variable region | IR-116 | U.S. Pat. No. 8,858,949 SEQ ID NO: 1620 | 3949 |
| AD805 | A beta oligomers | Light chain variable region | IR-117 | U.S. Pat. No. 8,858,949 SEQ ID NO: 1636 | 3950 |
| AD806 | A beta oligomers | Light chain variable region | IR-014 | U.S. Pat. No. 8,858,949 SEQ ID NO: 164 | 3951 |
| AD807 | A beta oligomers | Light chain variable region | IR-118 | U.S. Pat. No. 8,858,949 SEQ ID NO: 1652 | 3952 |
| AD808 | A beta oligomers | Light chain variable region | IR-119 | U.S. Pat. No. 8,858,949 SEQ ID NO: 1668 | 3953 |
| AD809 | A beta oligomers | Light chain variable region | IR-120 | U.S. Pat. No. 8,858,949 SEQ ID NO: 1684 | 3954 |
| AD810 | A beta oligomers | Light chain variable region | IR-121 | U.S. Pat. No. 8,858,949 SEQ ID NO: 1700 | 3955 |
| AD811 | A beta oligomers | Light chain variable region | IR-122 | U.S. Pat. No. 8,858,949 SEQ ID NO: 1716 | 3956 |
| AD812 | A beta oligomers | Light chain variable region | IR-123 | U.S. Pat. No. 8,858,949 SEQ ID NO: 1732 | 3957 |
| AD813 | A beta oligomers | Light chain variable region | IR-124 | U.S. Pat. No. 8,858,949 SEQ ID NO: 1748 | 3958 |
| AD814 | A beta oligomers | Light chain variable region | IR-125 | U.S. Pat. No. 8,858,949 SEQ ID NO: 1764 | 3959 |
| AD815 | A beta oligomers | Light chain variable region | IR-126 | U.S. Pat. No. 8,858,949 SEQ ID NO: 1780 | 3960 |
| AD816 | A beta oligomers | Light chain variable region | IR-127 | U.S. Pat. No. 8,858,949 SEQ ID NO: 1796 | 3961 |
| AD817 | A beta oligomers | Light chain variable region | IR-015 | U.S. Pat. No. 8,858,949 SEQ ID NO: 180 | 3962 |
| AD818 | A beta oligomers | Light chain variable region | IR-128 | U.S. Pat. No. 8,858,949 SEQ ID NO: 1812 | 3963 |
| AD819 | A beta oligomers | Light chain variable region | IR-129 | U.S. Pat. No. 8,858,949 SEQ ID NO: 1828 | 3964 |
| AD820 | A beta oligomers | Light chain variable region | IR-131 | U.S. Pat. No. 8,858,949 SEQ ID NO: 1844 | 3965 |
| AD821 | A beta oligomers | Light chain variable region | IR-132 | U.S. Pat. No. 8,858,949 SEQ ID NO: 1860 | 3966 |
| AD822 | A beta oligomers | Light chain variable region | IR-133 | U.S. Pat. No. 8,858,949 SEQ ID NO: 1876 | 3967 |
| AD823 | A beta oligomers | Light chain variable region | IR-134 | U.S. Pat. No. 8,858,949 SEQ ID NO: 1892 | 3968 |
| AD824 | A beta oligomers | Light chain variable region | IR-135 | U.S. Pat. No. 8,858,949 SEQ ID NO: 1908 | 3969 |
| AD825 | A beta oligomers | Light chain variable region | IR-136 | U.S. Pat. No. 8,858,949 SEQ ID NO: 1924 | 3970 |
| AD826 | A beta oligomers | Light chain variable region | IR-137 | U.S. Pat. No. 8,858,949 SEQ ID NO: 1940 | 3971 |
| AD827 | A beta oligomers | Light chain variable region | IR-138 | U.S. Pat. No. 8,858,949 SEQ ID NO: 1956 | 3972 |
| AD828 | A beta oligomers | Light chain variable region | IR-017 | U.S. Pat. No. 8,858,949 SEQ ID NO: 196 | 3973 |
| AD829 | A beta oligomers | Light chain variable region | IR-139 | U.S. Pat. No. 8,858,949 SEQ ID NO: 1972 | 3974 |
| AD830 | A beta oligomers | Light chain variable region | IR-140 | U.S. Pat. No. 8,858,949 SEQ ID NO: 1988 | 3975 |
| AD831 | A beta oligomers | Light chain variable region | IR-002 | U.S. Pat. No. 8,858,949 SEQ ID NO: 20 | 3976 |
| AD832 | A beta oligomers | Light chain variable region | IR-141 | U.S. Pat. No. 8,858,949 SEQ ID NO: 2004 | 3977 |
| AD833 | A beta oligomers | Light chain variable region | IR-142 | U.S. Pat. No. 8,858,949 SEQ ID NO: 2020 | 3978 |
| AD834 | A beta oligomers | Light chain variable region | IR-143 | U.S. Pat. No. 8,858,949 SEQ ID NO: 2036 | 3979 |
| AD835 | A beta oligomers | Light chain variable region | IR-144 | U.S. Pat. No. 8,858,949 SEQ ID NO: 2052 | 3980 |
| AD836 | A beta oligomers | Light chain variable region | IR-145 | U.S. Pat. No. 8,858,949 SEQ ID NO: 2068 | 3981 |
| AD837 | A beta oligomers | Light chain variable region | IR-146 | U.S. Pat. No. 8,858,949 SEQ ID NO: 2084 | 3982 |
| AD838 | A beta oligomers | Light chain variable region | IR-147 | U.S. Pat. No. 8,858,949 SEQ ID NO: 2100 | 3983 |
| AD839 | A beta oligomers | Light chain variable region | IR-149 | U.S. Pat. No. 8,858,949 SEQ ID NO: 2116 | 3984 |
| AD840 | A beta oligomers | Light chain variable region | IR-020 | U.S. Pat. No. 8,858,949 SEQ ID NO: 212 | 3985 |

TABLE 4-continued

Alzheimer's Disease Antibodies

| Antibody No. | Target | Description | Antibody Name | Reference Information | SEQ ID NO |
|---|---|---|---|---|---|
| AD841 | A beta oligomers | Light chain variable region | IR-150 | U.S. Pat. No. 8,858,949 SEQ ID NO: 2132 | 3986 |
| AD842 | A beta oligomers | Light chain variable region | IR-151 | U.S. Pat. No. 8,858,949 SEQ ID NO: 2148 | 3987 |
| AD843 | A beta oligomers | Light chain variable region | IR-152 | U.S. Pat. No. 8,858,949 SEQ ID NO: 2164 | 3988 |
| AD844 | A beta oligomers | Light chain variable region | IR-153 | U.S. Pat. No. 8,858,949 SEQ ID NO: 2180 | 3989 |
| AD845 | A beta oligomers | Light chain variable region | IR-154 | U.S. Pat. No. 8,858,949 SEQ ID NO: 2196 | 3990 |
| AD846 | A beta oligomers | Light chain variable region | IR-155 | U.S. Pat. No. 8,858,949 SEQ ID NO: 2212 | 3991 |
| AD847 | A beta oligomers | Light chain variable region | IR-156 | U.S. Pat. No. 8,858,949 SEQ ID NO: 2228 | 3992 |
| AD848 | A beta oligomers | Light chain variable region | IR-157 | U.S. Pat. No. 8,858,949 SEQ ID NO: 2244 | 3993 |
| AD849 | A beta oligomers | Light chain variable region | IR-158 | U.S. Pat. No. 8,858,949 SEQ ID NO: 2260 | 3994 |
| AD850 | A beta oligomers | Light chain variable region | IR-159 | U.S. Pat. No. 8,858,949 SEQ ID NO: 2276 | 3995 |
| AD851 | A beta oligomers | Light chain variable region | IR-021 | U.S. Pat. No. 8,858,949 SEQ ID NO: 228 | 3996 |
| AD852 | A beta oligomers | Light chain variable region | IR-022 | U.S. Pat. No. 8,858,949 SEQ ID NO: 244 | 3997 |
| AD853 | A beta oligomers | Light chain variable region | IR-023 | U.S. Pat. No. 8,858,949 SEQ ID NO: 260 | 3998 |
| AD854 | A beta oligomers | Light chain variable region | IR-024 | U.S. Pat. No. 8,858,949 SEQ ID NO: 276 | 3999 |
| AD855 | A beta oligomers | Light chain variable region | IR-160 | U.S. Pat. No. 8,858,949 SEQ ID NO: 2864 | 4000 |
| AD856 | A beta oligomers | Light chain variable region | IR-161 | U.S. Pat. No. 8,858,949 SEQ ID NO: 2880 | 4001 |
| AD857 | A beta oligomers | Light chain variable region | IR-025 | U.S. Pat. No. 8,858,949 SEQ ID NO: 292 | 4002 |
| AD858 | A beta oligomers | Light chain variable region | IR-026 | U.S. Pat. No. 8,858,949 SEQ ID NO: 308 | 4003 |
| AD859 | A beta oligomers | Light chain variable region | IR-027 | U.S. Pat. No. 8,858,949 SEQ ID NO: 324 | 4004 |
| AD860 | A beta oligomers | Light chain variable region | IR-028 | U.S. Pat. No. 8,858,949 SEQ ID NO: 340 | 4005 |
| AD861 | A beta oligomers | Light chain variable region | IR-029 | U.S. Pat. No. 8,858,949 SEQ ID NO: 356 | 4006 |
| AD862 | A beta oligomers | Light chain variable region | IR-004 | U.S. Pat. No. 8,858,949 SEQ ID NO: 36 | 4007 |
| AD863 | A beta oligomers | Light chain variable region | IR-030 | U.S. Pat. No. 8,858,949 SEQ ID NO: 372 | 4008 |
| AD864 | A beta oligomers | Light chain variable region | IR-031 | U.S. Pat. No. 8,858,949 SEQ ID NO: 388 | 4009 |
| AD865 | A beta oligomers | Light chain variable region | IR-001 | U.S. Pat. No. 8,858,949 SEQ ID NO: 4 | 4010 |
| AD866 | A beta oligomers | Light chain variable region | IR-032 | U.S. Pat. No. 8,858,949 SEQ ID NO: 404 | 4011 |
| AD867 | A beta oligomers | Light chain variable region | IR-033 | U.S. Pat. No. 8,858,949 SEQ ID NO: 420 | 4012 |
| AD868 | A beta oligomers | Light chain variable region | IR-034 | U.S. Pat. No. 8,858,949 SEQ ID NO: 436 | 4013 |
| AD869 | A beta oligomers | Light chain variable region | IR-035 | U.S. Pat. No. 8,858,949 SEQ ID NO: 452 | 4014 |
| AD870 | A beta oligomers | Light chain variable region | IR-036 | U.S. Pat. No. 8,858,949 SEQ ID NO: 468 | 4015 |
| AD871 | A beta oligomers | Light chain variable region | IR-037 | U.S. Pat. No. 8,858,949 SEQ ID NO: 484 | 4016 |
| AD872 | A beta oligomers | Light chain variable region | IR-038 | U.S. Pat. No. 8,858,949 SEQ ID NO: 500 | 4017 |
| AD873 | A beta oligomers | Light chain variable region | IR-039 | U.S. Pat. No. 8,858,949 SEQ ID NO: 516 | 4018 |
| AD874 | A beta oligomers | Light chain variable region | IR-005 | U.S. Pat. No. 8,858,949 SEQ ID NO: 52 | 4019 |
| AD875 | A beta oligomers | Light chain variable region | IR-040 | U.S. Pat. No. 8,858,949 SEQ ID NO: 532 | 4020 |
| AD876 | A beta oligomers | Light chain variable region | IR-041 | U.S. Pat. No. 8,858,949 SEQ ID NO: 548 | 4021 |
| AD877 | A beta oligomers | Light chain variable region | IR-043 | U.S. Pat. No. 8,858,949 SEQ ID NO: 564 | 4022 |

TABLE 4-continued

Alzheimer's Disease Antibodies

| Antibody No. | Target | Description | Antibody Name | Reference Information | SEQ ID NO |
|---|---|---|---|---|---|
| AD878 | A beta oligomers | Light chain variable region | IR-044 | U.S. Pat. No. 8,858,949 SEQ ID NO: 580 | 4023 |
| AD879 | A beta oligomers | Light chain variable region | IR-045 | U.S. Pat. No. 8,858,949 SEQ ID NO: 596 | 4024 |
| AD880 | A beta oligomers | Light chain variable region | IR-046 | U.S. Pat. No. 8,858,949 SEQ ID NO: 612 | 4025 |
| AD881 | A beta oligomers | Light chain variable region | IR-048 | U.S. Pat. No. 8,858,949 SEQ ID NO: 628 | 4026 |
| AD882 | A beta oligomers | Light chain variable region | IR-049 | U.S. Pat. No. 8,858,949 SEQ ID NO: 644 | 4027 |
| AD883 | A beta oligomers | Light chain variable region | IR-050 | U.S. Pat. No. 8,858,949 SEQ ID NO: 660 | 4028 |
| AD884 | A beta oligomers | Light chain variable region | IR-051 | U.S. Pat. No. 8,858,949 SEQ ID NO: 676 | 4029 |
| AD885 | A beta oligomers | Light chain variable region | IR-006 | U.S. Pat. No. 8,858,949 SEQ ID NO: 68 | 4030 |
| AD886 | A beta oligomers | Light chain variable region | IR-052 | U.S. Pat. No. 8,858,949 SEQ ID NO: 692 | 4031 |
| AD887 | A beta oligomers | Light chain variable region | IR-053 | U.S. Pat. No. 8,858,949 SEQ ID NO: 708 | 4032 |
| AD888 | A beta oligomers | Light chain variable region | IR-054 | U.S. Pat. No. 8,858,949 SEQ ID NO: 724 | 4033 |
| AD889 | A beta oligomers | Light chain variable region | IR-055 | U.S. Pat. No. 8,858,949 SEQ ID NO: 740 | 4034 |
| AD890 | A beta oligomers | Light chain variable region | IR-056 | U.S. Pat. No. 8,858,949 SEQ ID NO: 756 | 4035 |
| AD891 | A beta oligomers | Light chain variable region | IR-057 | U.S. Pat. No. 8,858,949 SEQ ID NO: 772 | 4036 |
| AD892 | A beta oligomers | Light chain variable region | IR-058 | U.S. Pat. No. 8,858,949 SEQ ID NO: 788 | 4037 |
| AD893 | A beta oligomers | Light chain variable region | IR-059 | U.S. Pat. No. 8,858,949 SEQ ID NO: 804 | 4038 |
| AD894 | A beta oligomers | Light chain variable region | IR-060 | U.S. Pat. No. 8,858,949 SEQ ID NO: 820 | 4039 |
| AD895 | A beta oligomers | Light chain variable region | IR-061 | U.S. Pat. No. 8,858,949 SEQ ID NO: 836 | 4040 |
| AD896 | A beta oligomers | Light chain variable region | IR-007 | U.S. Pat. No. 8,858,949 SEQ ID NO: 84 | 4041 |
| AD897 | A beta oligomers | Light chain variable region | IR-062 | U.S. Pat. No. 8,858,949 SEQ ID NO: 852 | 4042 |
| AD898 | A beta oligomers | Light chain variable region | IR-063 | U.S. Pat. No. 8,858,949 SEQ ID NO: 868 | 4043 |
| AD899 | A beta oligomers | Light chain variable region | IR-064 | U.S. Pat. No. 8,858,949 SEQ ID NO: 884 | 4044 |
| AD900 | A beta oligomers | Light chain variable region | IR-065 | U.S. Pat. No. 8,858,949 SEQ ID NO: 900 | 4045 |
| AD901 | A beta oligomers | Light chain variable region | IR-066 | U.S. Pat. No. 8,858,949 SEQ ID NO: 916 | 4046 |
| AD902 | A beta oligomers | Light chain variable region | IR-067 | U.S. Pat. No. 8,858,949 SEQ ID NO: 932 | 4047 |
| AD903 | A beta oligomers | Light chain variable region | IR-068 | U.S. Pat. No. 8,858,949 SEQ ID NO: 948 | 4048 |
| AD904 | A beta oligomers | Light chain variable region | IR-069 | U.S. Pat. No. 8,858,949 SEQ ID NO: 964 | 4049 |
| AD905 | A beta oligomers | Light chain variable region | IR-070 | U.S. Pat. No. 8,858,949 SEQ ID NO: 980 | 4050 |
| AD906 | A beta oligomers | Light chain variable region | IR-071 | U.S. Pat. No. 8,858,949 SEQ ID NO: 996 | 4051 |
| AD907 | AB (1-42) Globulomer | Light chain variable region | Hu8F5VL | US20090232801 SEQ ID NO: 105 | 4052 |
| AD908 | AB (1-42) Globulomer | Light chain variable region | TR1.37'CL | US20090232801 SEQ ID NO: 106 | 4053 |
| AD909 | AB (1-42) Globulomer | Light chain variable region | Hu8F5VL | US20090232801 SEQ ID NO: 112 | 4054 |
| AD910 | AB (1-42) Globulomer | Light chain variable region | 8F5 hum7 VH | US20090232801 SEQ ID NO: 2 | 4055 |
| AD911 | AB (20-42) Globulomer | Light chain variable region | VL 5F7hum8 | US20090175847 SEQ ID NO: 2 | 4056 |
| AD912 | AB (20-42) Globulomer | Light chain variable region | VL 7C6hum7 | US20090175847 SEQ ID NO: 4 | 4057 |
| AD913 | ADDL | Light chain variable region | | WO2007050359 SEQ ID NO: 112 | 4058 |
| AD914 | ADDL | Light chain variable region | | WO2007050359 SEQ ID NO: 140 | 4059 |

TABLE 4-continued

Alzheimer's Disease Antibodies

| Antibody No. | Target | Description | Antibody Name | Reference Information | SEQ ID NO |
|---|---|---|---|---|---|
| AD915 | amyloid beta peptide Aβ | Light chain variable region | | U.S. Pat. No. 719,576 SEQ ID NO: 7 | 4060 |
| AD916 | amyloid beta peptide Aβ | Light chain variable region | | U.S. Pat. No. 719,576 SEQ ID NO: 9 | 4061 |
| AD917 | amyloid oligomers | Light chain variable region | F11G3 | U.S. Pat. No. 9,125,846 SEQ ID NO: 12 | 3315 |
| AD918 | amyloid or amyloid-like proteins | Light chain variable region | Humanized C2 HIV 1 | WO2008061796 SEQ ID NO: 1 | 4062 |
| AD919 | amyloid protein (IGG1 Abeta) | Light chain variable region | C2 HuVK | US20100150906 SEQ ID NO: 12 | 4063 |
| AD920 | amyloid β peptide | Light chain variable region | Fv1E4 | U.S. Pat. No. 8,222,002 SEQ ID NO: 16 | 4064 |
| AD921 | amyloid β peptide | Light chain variable region | Fv1E7 | U.S. Pat. No. 8,222,002 SEQ ID NO: 26 | 4065 |
| AD922 | amyloid β peptide | Light chain variable region | Fv2A7 | U.S. Pat. No. 8,222,002 SEQ ID NO: 36 | 4066 |
| AD923 | amyloid β peptide | Light chain variable region | Fv2A8 | U.S. Pat. No. 8,222,002 SEQ ID NO: 46 | 4067 |
| AD924 | amyloid β peptide | Light chain variable region | Fv2B6 | U.S. Pat. No. 8,222,002 SEQ ID NO: 56 | 4068 |
| AD925 | amyloid β peptide | Light chain variable region | Fv1E1 | U.S. Pat. No. 8,222,002 SEQ ID NO: 6 | 4069 |
| AD926 | amyloid β peptide | Light chain variable region | B7 | U.S. Pat. No. 8,222,002 SEQ ID NO: 66 | 4070 |
| AD927 | amyloid β peptide | Light chain variable region | B6 | U.S. Pat. No. 8,222,002 SEQ ID NO: 76 | 4071 |
| AD928 | amyloid β peptide | Light chain variable region | F10 | U.S. Pat. No. 8,222,002 SEQ ID NO: 86 | 4072 |
| AD929 | amyloid β peptide | Light chain variable region | D1 | U.S. Pat. No. 8,222,002 SEQ ID NO: 96 | 4073 |
| AD930 | ApoE-CTD | Light chain variable region | 807B-M0001-B07 | WO2005051998 SEQ ID NO: 150 | 4074 |
| AD931 | ApoE-CTD | Light chain variable region | 807B-M0004-A03 | WO2005051998 SEQ ID NO: 151 | 4075 |
| AD932 | ApoE-CTD | Light chain variable region | 807B-M0004-A05 | WO2005051998 SEQ ID NO: 152 | 4076 |
| AD933 | ApoE-CTD | Light chain variable region | 807B-M0004-C04 | WO2005051998 SEQ ID NO: 153 | 4077 |
| AD934 | ApoE-CTD | Light chain variable region | 807B-M0004-C05 | WO2005051998 SEQ ID NO: 154 | 4078 |
| AD935 | ApoE-CTD | Light chain variable region | 807B-M0004-F06 | WO2005051998 SEQ ID NO: 155 | 4079 |
| AD936 | ApoE-CTD | Light chain variable region | 807B-M0004-F10 | WO2005051998 SEQ ID NO: 156 | 4080 |
| AD937 | ApoE-CTD | Light chain variable region | 807B-M0004-H03 | WO2005051998 SEQ ID NO: 157 | 4081 |
| AD938 | ApoE-CTD | Light chain variable region | 807B-M0009-C03 | WO2005051998 SEQ ID NO: 158 | 4082 |
| AD939 | ApoE-CTD | Light chain variable region | 807B-M0009-F06 | WO2005051998 SEQ ID NO: 159 | 4083 |
| AD940 | ApoE-CTD | Light chain variable region | 807B-M0013-A12 | WO2005051998 SEQ ID NO: 160 | 4084 |
| AD941 | ApoE-CTD | Light chain variable region | 807B-M0079-D10 | WO2005051998 SEQ ID NO: 161 | 4085 |
| AD942 | ApoE-CTD | Light chain variable region | 807B-M0081-F12 | WO2005051998 SEQ ID NO: 162 | 4086 |
| AD943 | ApoE-CTD | Light chain variable region | 807B-M0081-H03 | WO2005051998 SEQ ID NO: 163 | 4087 |
| AD944 | ApoE-CTD | Light chain variable region | 807B-M0083-E11 | WO2005051998 SEQ ID NO: 164 | 4088 |
| AD945 | ApoE-CTD | Light chain variable region | 807A-M0027-E11 | WO2005051998 SEQ ID NO: 42 | 4089 |
| AD946 | ApoE-CTD | Light chain variable region | 807A-M0028-B02 | WO2005051998 SEQ ID NO: 43 | 4090 |
| AD947 | ApoE-CTD | Light chain variable region | 807A-M0026-F05 | WO2005051998 SEQ ID NO: 44 | 4091 |
| AD948 | APP | Light chain variable region | | WO2014151747 SEQ NO 47 | 4092 |
| AD949 | APP | Light chain variable region | | WO2014151747 SEQ NO 45 | 4093 |
| AD950 | APP | Light chain variable region | | WO2014151747 SEQ NO 49 | 4094 |
| AD951 | APP | Light chain variable region | | WO2014151747 SEQ NO 51 | 4095 |

TABLE 4-continued

Alzheimer's Disease Antibodies

| Antibody No. | Target | Description | Antibody Name | Reference Information | SEQ ID NO |
|---|---|---|---|---|---|
| AD952 | Aβ amyloid | Light chain variable region | 15C11 | WO2006066049 SEQ ID NO: 2 | 4096 |
| AD953 | Aβ amyloid | Light chain variable region | 9G8 | WO2006066049 SEQ ID NO: 8 | 4097 |
| AD954 | Aβ amyloid | Light chain variable region | 266 | WO2006066049 SEQ ID NO: 9 | 4098 |
| AD955 | Aβ amyloid | Light chain variable region | 12A1 | WO2006066089 SEQ ID NO: 2 | 4099 |
| AD956 | Aβ amyloid | Light chain variable region | 12A1 | WO2006066089 SEQ ID NO: 4 | 4100 |
| AD957 | Aβ amyloid | Light chain variable region | humanized 12Al 1 | WO2006066089 SEQ ID NO: 7 | 4101 |
| AD958 | Aβ amyloids | Light chain variable region | Humanized 3D6 (Bapineuzumb) | U.S. Pat. No. 8,784,810 SEQ ID NO: 1 | 4102 |
| AD959 | Aβ amyloids | Light chain variable region | Humanized 10D5 | U.S. Pat. No. 8,784,810 SEQ ID NO: 28 | 4103 |
| AD960 | Aβ amyloids | Light chain variable region | Humanized 3D6 (Bapineuzumb), version 2 | U.S. Pat. No. 8,784,810 SEQ ID NO: 3 | 4104 |
| AD961 | Aβ amyloids | Light chain variable region | Humanized 12A11 | U.S. Pat. No. 8,784,810 SEQ ID NO: 7 | 4105 |
| AD962 | Aβ peptide | Light chain variable region | | U.S. Pat. No. 8,066,999 SEQ ID NO: 1 | 4106 |
| AD963 | Aβ polypeptide | Light chain variable region | preferred embodiment 1, 8, 12 | WO2008084402 SEQ ID NO: 145 | 4107 |
| AD964 | Aβ polypeptide | Light chain variable region | preferred embodiment 5, 13 | WO2008084402 SEQ ID NO: 146 | 4108 |
| AD965 | Aβ polypeptide | Light chain variable region | | WO2008084402 SEQ ID NO: 147 | 4109 |
| AD966 | Aβ polypeptide | Light chain variable region | | WO2008084402 SEQ ID NO: 47 | 4110 |
| AD967 | Aβ polypeptide | Light chain variable region | | WO2008084402 SEQ ID NO: 48 | 4111 |
| AD968 | Aβ polypeptide | Light chain variable region | | WO2008084402 SEQ ID NO: 49 | 4112 |
| AD969 | Aβ polypeptide | Light chain variable region | | WO2008084402 SEQ ID NO: 50 | 4113 |
| AD970 | Aβ polypeptide | Light chain variable region | preferred embodiment 3 | WO2008084402 SEQ ID NO: 51 | 4114 |
| AD971 | Aβ polypeptide | Light chain variable region | preferred embodiment 4 | WO2008084402 SEQ ID NO: 52 | 4115 |
| AD972 | Aβ polypeptide | Light chain variable region | preferred embodiment 2, 6 | WO2008084402 SEQ ID NO: 53 | 4116 |
| AD973 | Aβ polypeptide | Light chain variable region | preferred embodiment 9, 10, 11 | WO2008084402 SEQ ID NO: 54 | 4117 |
| AD974 | Aβ polypeptide | Light chain variable region | preferred embodiment 7 | WO2008084402 SEQ ID NO: 55 | 4118 |
| AD975 | Aβ polypeptide | Light chain variable region | | WO2008084402 SEQ ID NO: 56 | 4119 |
| AD976 | beta amyloid | Light chain variable region | 12B4 | U.S. Pat. No. 7,256,273 SEQ ID NO: 2 | 4120 |
| AD977 | beta amyloid | Light chain variable region | Germline A19 | U.S. Pat. No. 7,256,273 SEQ ID NO: 30 | 4121 |
| AD978 | beta amyloid | Light chain variable region | Kabat ID 000333 | U.S. Pat. No. 7,256,273 SEQ ID NO: 32 | 4122 |
| AD979 | beta amyloid | Light chain variable region | humanized 12B4 | U.S. Pat. No. 7,256,273 SEQ ID NO: 6 | 4123 |
| AD980 | beta amyloid | Light chain variable region | VL A | U.S. Pat. No. 8,323,647 SEQ ID NO: 10 | 4124 |
| AD981 | beta amyloid | Light chain variable region | VL B | U.S. Pat. No. 8,323,647 SEQ ID NO: 11 | 4125 |
| AD982 | beta amyloid | Light chain variable region | VL C | U.S. Pat. No. 8,323,647 SEQ ID NO: 12 | 4126 |
| AD983 | beta amyloid | Light chain variable region | VL D | U.S. Pat. No. 8,323,647 SEQ ID NO: 13 | 4127 |
| AD984 | beta amyloid | Light chain variable region | VL E | U.S. Pat. No. 8,323,647 SEQ ID NO: 14 | 4128 |
| AD985 | beta amyloid | Light chain variable region | VL F | U.S. Pat. No. 8,323,647 SEQ ID NO: 15 | 4129 |
| AD986 | beta amyloid | Light chain variable region | VL G | U.S. Pat. No. 8,323,647 SEQ ID NO: 16 | 4130 |
| AD987 | beta amyloid | Light chain variable region | ESBA212 | U.S. Pat. No. 8,323,647 SEQ ID NO: 7 | 4131 |
| AD988 | beta amyloid | Light chain variable region | Framework 2.3 | U.S. Pat. No. 8,323,647 SEQ ID NO: 8 | 4132 |

TABLE 4-continued

Alzheimer's Disease Antibodies

| Antibody No. | Target | Description | Antibody Name | Reference Information | SEQ ID NO |
|---|---|---|---|---|---|
| AD989 | beta amyloid | Light chain variable region | 22C4 | U.S. Pat. No. 8,323,647 SEQ ID NO: 9 | 4133 |
| AD990 | beta amyloid | Light chain variable region | | U.S. Pat. No. 10/476,265 SEQ ID NO: 7 | 4134 |
| AD991 | beta amyloid | Light chain variable region | | U.S. Pat. No. 10/476,265 SEQ ID NO: 8 | 4135 |
| AD992 | beta amyloid | Light chain variable region | | U.S. Pat. No. 10/476,265 SEQ ID NO: 9 | 4136 |
| AD993 | beta amyloid | Light chain variable region | ACI-11-Ab-9 | US20140199323 SEQ ID NO: 7 | 4137 |
| AD994 | beta amyloid | Light chain variable region | ACI-12-Ab-11 | US20140199323 SEQ ID NO: 9 | 4138 |
| AD995 | beta amyloid | Light chain variable region | 8C5 | US20150071915 SEQ ID NO: 20 | 4139 |
| AD996 | beta amyloid | Light chain variable region | 8F5 | US20150071915 SEQ ID NO: 4 | 4140 |
| AD997 | beta amyloid | Light chain variable region | | U.S. Pat. No. 7,189,819 SEQ ID NO: 11 | 4141 |
| AD998 | beta amyloid | Light chain variable region | 10D5 | U.S. Pat. No. 7,189,819 SEQ ID NO: 14 | 4142 |
| AD999 | beta amyloid | Light chain variable region | m3D6 | U.S. Pat. No. 7,189,819 SEQ ID NO: 2 | 4143 |
| AD1000 | beta amyloid | Light chain variable region | humanized 3D6 | U.S. Pat. No. 7,189,819 SEQ ID NO: 5 | 4144 |
| AD1001 | beta amyloid | Light chain variable region | Kabal ID 109230 | U.S. Pat. No. 7,189,819 SEQ ID NO: 6 | 4145 |
| AD1002 | beta amyloid | Light chain variable region | germline A19 antibody | U.S. Pat. No. 7,189,819 SEQ ID NO: 7 | 4146 |
| AD1003 | beta amyloid | Light chain variable region | Bapineuzumab, AAB-001 | U.S. Pat. No. 8,613,920 SEQ ID NO: 1 | 4147 |
| AD1004 | beta amyloid peptide | Light chain variable region | CAA51135 | WO2007113172 SEQ ID NO: 24 | 4148 |
| AD1005 | beta amyloid peptide | Light chain variable region | Humanized L1 | WO2007113172 SEQ ID NO: 32 | 4149 |
| AD1006 | beta amyloid peptide | Light chain variable region | Mature H2 | WO2007113172 SEQ ID NO: 36 | 4150 |
| AD1007 | BETA-AMYLOID | Light chain variable region | NI-101.12 | WO2008081008 SEQ ID NO: 12 | 4151 |
| AD1008 | BETA-AMYLOID | Light Chain variable region | NI-101.13 | WO2008081008 SEQ ID NO: 16 | 4152 |
| AD1009 | BETA-AMYLOID | Light chain variable region | NI-101.12F6A | WO2008081008 SEQ ID NO: 41 | 4153 |
| AD1010 | BETA-AMYLOID | Light chain variable region | NI-101.13A | WO2008081008 SEQ ID NO: 43 | 4154 |
| AD1011 | BETA-AMYLOID | Light chain variable region | NI-101.13B | WO2008081008 SEQ ID NO: 45 | 4155 |
| AD1012 | BETA-AMYLOID | Light chain variable region | NI-101.10, NI-101.11 | WO2008081008 SEQ ID NO: 8 | 4156 |
| AD1013 | DR6 and P75 | Light chain variable region | M73-C04 | WO2010062904 SEQ ID NO: 102 | 3316 |
| AD1014 | DR6 and P75 | Light chain variable region | 1P1D6.3 | WO2010062904 SEQ ID NO: 112 | 3317 |
| AD1015 | DR6 and P75 | Light chain variable region | M50-H02 | WO2010062904 SEQ ID NO: 12 | 3318 |
| AD1016 | DR6 and P75 | Light chain variable region | 1P2F2.1 | WO2010062904 SEQ ID NO: 122 | 3319 |
| AD1017 | DR6 and P75 | Light chain variable region | 1P5D10.2 | WO2010062904 SEQ ID NO: 132 | 3320 |
| AD1018 | DR6 and P75 | Light chain variable region | M51-H09 | WO2010062904 SEQ ID NO: 22 | 3321 |
| AD1019 | DR6 and P75 | Light chain variable region | M53-E04 | WO2010062904 SEQ ID NO: 32 | 3322 |
| AD1020 | DR6 and P75 | Light chain variable region | M53-F04 | WO2010062904 SEQ ID NO: 42 | 3323 |
| AD1021 | DR6 and P75 | Light chain variable region | M62-B02 | WO2010062904 SEQ ID NO: 52 | 3324 |
| AD1022 | DR6 and P75 | Light chain variable region | M63-E10 | WO2010062904 SEQ ID NO: 62 | 3325 |
| AD1023 | DR6 and P75 | Light chain variable region | M66-B03 | WO2010062904 SEQ ID NO: 72 | 3326 |
| AD1024 | DR6 and P75 | Light chain variable region | M67-G02 | WO2010062904 SEQ ID NO: 82 | 3327 |
| AD1025 | DR6 and P75 | Light chain variable region | M72-F03 | WO2010062904 SEQ ID NO: 92 | 3328 |

TABLE 4-continued

Alzheimer's Disease Antibodies

| Antibody No. | Target | Description | Antibody Name | Reference Information | SEQ ID NO |
|---|---|---|---|---|---|
| AD1026 | IOD5 | Light chain variable region | | WO2002088307 SEQ ID NO: 11 | 4157 |
| AD1027 | IOD5 | Light chain variable region | | WO2002088307 SEQ ID NO: 7 | 4158 |
| AD1028 | IOD5 | Light chain variable region | | WO2002088307 SEQ ID NO: 9 | 4159 |
| AD1029 | LPG (lysophatidylglucoside) | Light chain variable region | #7 | U.S. Pat. No. 8,591,902 SEQ ID NO: 17 | 3329 |
| AD1030 | LPG (lysophatidylglucoside) | Light chain variable region | #15 | U.S. Pat. No. 8,591,902 SEQ ID NO: 7 | 3330 |
| AD1031 | MAG | Light chain variable region | | U.S. Pat. No. 8,071,731 SEQ ID NO: 16 | 3331 |
| AD1032 | MAG | Light chain variable region | | U.S. Pat. No. 8,071,731 SEQ ID NO: 17 | 3332 |
| AD1033 | MAG | Light chain variable region | | U.S. Pat. No. 8,071,731 SEQ ID NO: 18 | 3333 |
| AD1034 | MAG | Light chain variable region | | U.S. Pat. No. 8,071,731 SEQ ID NO: 19 | 3334 |
| AD1035 | MAI (myelin associated inhibitor) | Light chain variable region | | WO2013158748 SEQ ID NO: 11 | 3335 |
| AD1036 | MAI (myelin associated inhibitor) | Light chain variable region | | WO2013158748 SEQ ID NO: 27 | 3336 |
| AD1037 | NMDA | Light chain variable region | | EP2805972 SEQ ID NO: 44 | 3337 |
| AD1038 | NOGO | Light chain variable region | H1L6, H5L6, H6L6, H14L6, H15L6, H16L6, H17L6, H18L6, H19L6, H20L6, H21L6, H22L6, H23L6, H24L6, H25L6, H700L6 | US20140147435 SEQ ID NO: 19 | 3338 |
| AD1039 | NOGO | Light chain variable region | H1L13, H5L13, H6L13, H14L13, H15L13, H16L13, H17L13, H18L13, H19L13, H20L13, H21L13, H22L13, H23L13, H24L13, H25L13, H700L13 | US20140147435 SEQ ID NO: 20 | 3339 |
| AD1040 | NOGO | Light chain variable region | H1L14, H5L14, H6L14, H14L14, H15L14, H16L14, H17L14, H18L14, H19L14, H20L14, H21L14, H22L14, H23L14, H24L14, H25L14, H700L14 | US20140147435 SEQ ID NO: 21 | 3340 |
| AD1041 | NOGO | Light chain variable region | H1L15, H5L15, H6L15, H14L15, H15L15, H16l15, H17L15, H18L15, H19L15, H20L15, H21L15, H22L15, H23L15, H24L15, H25L15, H700L15 | US20140147435 SEQ ID NO: 22 | 3341 |
| AD1042 | NOGO | Light chain variable region | H1L16, H5L16, H6L16, H14L16, H15L16, H16L16, H17L16, H18L16, H19L16, H20L16, H21L16, H22L16, H23L16, H24L16, H25L16, H700L16 | US20140147435 SEQ ID NO: 23 | 3342 |
| AD1043 | NOGO | Light chain variable region | H1L17, H5L17, H6L17, H14L17, H15L17, H16L17, H17L17, H18L17, H19L17, H20L17, H21L17, H22L17, H23L17, H24L17, H25L17, H700L17 | US20140147435 SEQ ID NO: 24 | 3343 |

TABLE 4-continued

Alzheimer's Disease Antibodies

| Antibody No. | Target | Description | Antibody Name | Reference Information | SEQ ID NO |
|---|---|---|---|---|---|
| AD1044 | NOGO | Light chain variable region | H1L18, H5L18, H6L18, H14L18, H15L18, H16L18, H17L18, H18L18, H19L18, H20L18, H21L18, H22L18, H23L18, H24L18, H25L18, H700L18 | US20140147435 SEQ ID NO: 25 | 3344 |
| AD1045 | NOGO | Light chain variable region | H5L11, H6L11, H14L11, H15L11, H16L11, H17L11, H18L11, H19L11, H20L11, H21L11, H22L11, H23L11, H24L11, H25L11, H700L11 | US20140147435 SEQ ID NO: 78 | 3345 |
| AD1046 | Nogo-66 | Light chain variable region | Antibody clone 50 | US20140065155 SEQ ID NO: 4 | 3346 |
| AD1047 | Nogo-66 | Light chain variable region | Antibody clone 51 | US20140065155 SEQ ID NO: 6 | 3347 |
| AD1048 | NogoA/NiG | Light chain variable region | 6A3-Ig4 | WO2009056509 SEQ ID NO: 25 | 3348 |
| AD1049 | NogoA/NiG | Light chain variable region | 6A3-IgG1 | WO2009056509 SEQ ID NO: 5 | 3349 |
| AD1050 | N-terminal region of Aβ8-x peptide | Light chain variable region | Antibody TeiA 1.6 (Secreted by Hybridoma IGH521) | US20110059092 SEQ ID NO: 1 | 4160 |
| AD1051 | N-terminal region of Aβ8-x peptide | Light chain variable region | Antibody TeiA 1.7 (Secreted by Hybridoma IGH522) | US20110059092 SEQ ID NO: 3 | 4161 |
| AD1052 | N-terminal region of Aβ8-x peptide | Light chain variable region | Antibody TeiA 1.8 (Secreted by Hybridoma IGH523) | US20110059092 SEQ ID NO: 5 | 4162 |
| AD1053 | N-terminal region of Aβ8-x peptide | Light chain variable region | Antibody TeiA 2b.6 (Secreted by Hybridoma IGH524) | US20110059092 SEQ ID NO: 7 | 4163 |
| AD1054 | N-terminal region of Aβ8-x peptide | Light chain variable region | Antibody TeiA 1.1 (Secreted by Hybridoma IGH525) | US20110059092 SEQ ID NO: 9 | 4164 |
| AD1055 | oligomers of N-terminal truncated Aβ | Light chain variable region | 9D5 | U.S. Pat. No. 8,795,664 SEQ ID NO: 28 | 4165 |
| AD1056 | oligomers of N-terminal truncated Aβ | Light chain variable region | 8C4 | U.S. Pat. No. 8,795,664 SEQ ID NO: 32 | 4166 |
| AD1057 | PrPC and/or PrPSc | Light chain variable region | | US20150166668 SEQ ID NO: 7 | 4167 |
| AD1058 | pyroglutamated Aβ | Light chain variable region | | WO2012136552 SEQ ID NO: 11 | 4168 |
| AD1059 | pyroglutamated Aβ | Light chain variable region | | WO2012136552 SEQ ID NO: 27 | 4169 |
| AD1060 | pyroglutamated Aβ | Light chain variable region | | WO2012136552 SEQ ID NO: 31 | 4170 |
| AD1061 | pyroglutamated Aβ | Light chain variable region | | WO2012136552 SEQ ID NO: 7 | 4171 |
| AD1062 | RGM A | Light chain variable region | 5F9.1-GL, 5F9.1-GL, 5F9.1-GL, 5F9.1-GL, 5F9.1-GL, 5F9.1-GL, 5F9.1-GL, 5F9.1-GL, 5F9.1-GL, 5F9.1-GL, h5F9.4, h5F9.11, h5F9.12 | US20150183871 SEQ ID NO: 44 | 3350 |
| AD1063 | RGM A | Light chain variable region | 5F9.2-GL, 5F9.2-GL, 5F9.2-GL, 5F9.2-GL, 5F9.2-GL, 5F9.2-GL, 5F9.2-GL, 5F9.2-GL, h5F9.5, h5F9.19, h5F9.20 | US20150183871 SEQ ID NO: 45 | 3351 |
| AD1064 | RGM A | Light chain variable region | 5F9.3-GL, 5F9.3-GL, 5F9.3-GL, 5F9.3-GL, 5F9.3-GL, 5F9.3-GL, 5F9.3-GL, 5F9.3-GL, | US20150183871 SEQ ID NO: 46 | 3352 |

TABLE 4-continued

Alzheimer's Disease Antibodies

| Antibody No. | Target | Description | Antibody Name | Reference Information | SEQ ID NO |
|---|---|---|---|---|---|
| AD1065 | RGM A | Light chain variable region | h5F9.6, h5F9.21, h5F9.22 h5F9.5, h5F9.6, h5F9,7, h5F9,8, h5F9.9, h5F9.10 | US20150183871 SEQ ID NO: 48 | 3353 |
| AD1066 | RGM A | Light chain variable region | h5F9.11, h5F9.19, h5F9.21 | US20150183871 SEQ ID NO: 49 | 3354 |
| AD1067 | RGM A | Light chain variable region | h5F9.1.2, h5F9.20, h5F9.22, h5F9.23, h5F9.25, h5F9.25, h5F9.26 | US20150183871 SEQ ID NO. 50 | 3355 |
| AD1068 | RGM A | Light chain variable region | h5F9.1, h5F9.7, h5F9.23 | US20150183871 SEQ ID NO: 51 | 3356 |
| AD1069 | RGM A | Light chain variable region | h5F9.2, h5F9.8, h5F9.25 | US20150183871 SEQ ID NO: 52 | 3357 |
| AD1070 | RGMa | Light chain variable region | AE12-1 | US20140023659 SEQ ID NO: 5 | 3368 |
| AD1071 | RGMa | Light chain variable region | AE12-7 | US20140023659 SEQ ID NO: 53 | 3369 |
| AD1072 | RGMa | Light chain variable region | AE12-8 | US20140023659 SEQ ID NO: 61 | 3370 |
| AD1073 | RGMa | Light chain variable region | AE12-13 | US20140023659 SEQ ID NO: 95 | 3371 |
| AD1074 | RGMa | Light chain variable region | AE12-15 | US20140023659 SEQ ID NO: 103 | 3358 |
| AD1075 | RGMa | Light chain variable region | AE12-20 | US20140023659 SEQ ID NO: 111 | 3359 |
| AD1076 | RGMa | Light chain variable region | AE12-21 | US20140023659 SEQ ID NO: 119 | 3360 |
| AD1077 | RGMa | Light chain variable region | AE12-23 | US20140023659 SEQ ID NO: 127 | 3361 |
| AD1078 | RGMa | Light chain variable region | AE12-2 | US20140023659 SEQ ID ID: 13 | 3362 |
| AD1079 | RGMa | Light chain variable region | AE12-24 | US20140023659 SEQ ID NO: 135 | 3363 |
| AD1080 | RGMa | Light chain variable region | AE12-3 | US20140023659 SEQ ID NO: 21 | 3364 |
| AD1081 | RGMa | Light chain variable region | AE12-4 | US20140023659 SEQ ID NO: 29 | 3365 |
| AD1082 | RGMa | Light chain variable region | AE12-5 | US20140023659 SEQ ID NO: 37 | 3366 |
| AD1083 | RGMa | Light chain variable region | AE12-6 | US20140023659 SEQ ID NO: 45 | 3367 |
| AD1084 | tau | Light chain variable region | NI-105.4E4 | US20150252102 SEQ ID NO: 11 | 4172 |
| AD1085 | tau | Light chain variable region | NI-105.4B2 | US20150252102 SEQ ID NO: 15 | 4173 |
| AD1086 | tau | Light chain variable region | NI-105.4A3 | US20150252102 SEQ ID NO: 19 | 4174 |
| AD1087 | tau | Light chain variable region | | WO2013041962 SEQ ID NO: 141 | 4175 |
| AD1088 | tau | Light chain variable region | | WO2013041962 SEQ ID NO: 142 | 4176 |
| AD1089 | tau | Light chain variable region | | WO2013041962 SEQ ID NO: 143 | 4177 |
| AD1090 | tau | Light chain variable region | | WO2013041962 SEQ ID NO: 150 | 4178 |
| AD1091 | tau | Light chain variable region | | WO2013041962 SEQ ID NO: 152 | 4179 |
| AD1092 | tau | Light chain variable region | | WO2013041962 SEQ ID NO: 153 | 4180 |
| AD1093 | tau | Light chain variable region | | WO2014100600 SEQID NO: 221 | 4181 |
| AD1094 | tau | Light chain variable region | | WO2014100600 SEQID NO: 222 | 4182 |
| AD1095 | tau | Light chain variable region | NI-105.17C1 | WO2014100600 SEQID NO: 46 | 4183 |
| AD1096 | tau | Light chain variable region | NI-105.6C5 | WO2014100600 SEQID NO: 49 | 4184 |
| AD1097 | tau | Light chain variable region | NI-105.29G10 | WO2014100600 SEQID NO: 51 | 4185 |
| AD1098 | tau | Light chain variable region | NI-105.6L9 | WO2014100600 SEQID NO: 53 | 4186 |
| AD1099 | tau | Light chain variable region | NI-105.40E8 | WO2014100600 SEQID NO: 55 | 4187 |

TABLE 4-continued

Alzheimer's Disease Antibodies

| Antibody No. | Target | Description | Antibody Name | Reference Information | SEQ ID NO |
|---|---|---|---|---|---|
| AD1100 | tau | Light chain variable region | NI-105.48E5 | WO2014100600 SEQID NO: 57 | 4188 |
| AD1101 | tau | Light chain variable region | NI-105.6E3 | WO2014100600 SEQID NO: 59 | 4189 |
| AD1102 | tau | Light chain variable region | NI-105.22E1 | WO2014100600 SEQID NO: 61 | 4190 |
| AD1103 | tau | Light chain variable region | | WO2014100600 SEQID NO: 63 | 4191 |
| AD1104 | tau | Light chain variable region | NI-105.26B12 | WO2014100600 SEQID NO: 64 | 4192 |
| AD1105 | tau | Light chain variable region | NI-105.12E12 | WO2014100600 SEQID NO: 66 | 4193 |
| AD1106 | tau | Light chain variable region | NI-105.60E7 | WO2014100600 SEQID NO: 68 | 4194 |
| AD1107 | tau | Light chain variable region | NI-105,14E2 | WO2014100600 SEQID NO: 70 | 4195 |
| AD1108 | tau | Light chain variable region | NI-105.39E2 | WO2014100600 SEQID NO: 72 | 4196 |
| AD1109 | tau | Light chain variable region | NI-105.19C6 | WO2014100600 SEQID NO: 74 | 4197 |
| AD1110 | tau | Light chain variable region | | WO2014100600 SEQID NO: 77 | 4198 |
| AD1111 | tau | Light chain variable region | NI-105.9C4 | WO2014100600 SEQID NO: 78 | 4199 |
| AD1112 | tau | Light chain variable region | IPN002 variant 1 | U.S. Pat. No. 8,926,974 SEQ ID NO: 40 | 4200 |
| AD1113 | tau | Light chain variable region | IPN002 variant 2 | U.S. Pat. No. 8,926,974 SEQ ID NO: 41 | 4201 |
| AD1114 | tau | Light chain variable region | IPN002 variant 3 | U.S. Pat. No. 8,926,974 SEQ ID NO: 42 | 4202 |
| AD1115 | tau | Light chain variable region | IPIN002 variant 4 | U.S. Pat. No. 8,926,974 SEQ ID NO: 43 | 4203 |
| AD1116 | tau | Light chain variable region | PT1 | US20150307600 SEQ ID NO: 36 | 4204 |
| AD1117 | tau | Light chain variable region | PT3 | US20150307600 SEQ ID NO: 38 | 4205 |
| AD1118 | tau | Light chain variable region | | U.S. Pat. No. 9,304,138 SEQ ID NO: 6 | 4206 |
| AD1119 | tau | Light chain variable region | | U.S. Pat. No. 9,304,138 SEQ ID NO: 7 | 4207 |
| AD1120 | tau | Light chain variable region | | U.S. Pat. No. 9,304,138 SEQ ID NO: 8 | 4208 |
| AD1121 | tau | Light chain variable region | | U.S. Pat. No. 9,304,138 SEQ ID NO: 9 | 4209 |
| AD1122 | tau | Light chain variable region | | U.S. Pat. No. 9,304,138 SEQ ID NO: 10 | 4210 |
| AD1123 | tau | Light chain variable region | | U.S. Pat. No. 9,304,138 SEQ ID NO: 11 | 4211 |
| AD1124 | tau | Light chain variable region | | U.S. Pat. No. 9,304,138 SEQ ID NO: 69 | 4212 |
| AD1125 | tau | Light chain variable region | | U.S. Pat. No. 9,304,138 SEQ ID NO: 77 | 4213 |
| AD1126 | tau | Light chain variable region | | U.S. Pat. No. 9,304,138 SEQ ID NO: 92 | 4214 |
| AD1127 | tau | Light chain variable region | | U.S. Pat. No. 9,304,138 SEQ ID NO: 97 | 4215 |
| AD1128 | tau | Light chain variable region | | U.S. Pat. No. 9,304,138 SEQ ID NO: 105 | 4216 |
| AD1129 | tau | Light chain variable region | | U.S. Pat. No. 9,304,138 SEQ ID NO: 116 | 4217 |
| AD1130 | tau | Light chain variable region | | U.S. Pat. No. 9,304,138 SEQ ID NO: 118 | 4218 |
| AD1131 | tau | Light chain variable region | hACl-36-3A8-Ab1 | US20150175682 SEQ ID NO: 8 | 4219 |
| AD1132 | tau | Light chain variable region | hACl-36-2B6-Ab1 | US20150175682 SEQ ID NO: 9 | 4220 |
| AD1133 | tau | Light chain variable region | ADx210 | US20140161875 SEQ ID NO: 16 | 4221 |
| AD1134 | tau | Light chain variable region | ADx210 isoform | US20140161875 SEQ ID NO: 18 | 4222 |
| AD1135 | tau | Light chain variable region | ADx215 | US20140161875 SEQ ID NO: 26 | 4223 |
| AD1136 | tau antigen | Light chain variable region | ADx202 | WO2015004163 SEQ ID NO: 9 | 4224 |

TABLE 4-continued

Alzheimer's Disease Antibodies

| Antibody No. | Target | Description | Antibody Name | Reference Information | SEQ ID NO |
|---|---|---|---|---|---|
| AD1137 | tau ps 422 | Light chain variable region | antibody Mab2.10.3 | US20110059093 SEQ ID NO: 1 | 4225 |
| AD1138 | tau ps 422 | Light chain variable region | Mab 005 | US20110059093 SEQ ID NO: 26 | 4226 |
| AD1139 | tau ps 422 | Light chain variable region | Mab 019 | US20110059093 SEQ ID NO: 34 | 4227 |
| AD1140 | tau ps 422 | Light chain variable region | Mab 020 | US20110059093 SEQ ID NO: 42 | 4228 |
| AD1141 | tau ps 422 | Light chain variable region | Mab 085 | US20110059093 SEQ ID NO: 50 | 4229 |
| AD1142 | tau ps 422 | Light chain variable region | Mab 086 | US20110059093 SEQ ID NO: 58 | 4230 |
| AD1143 | tau ps 422 | Light chain variable region | Mab 097 | US20110059093 SEQ ID NO: 66 | 4231 |
| AD1144 | TrkA | Light chain variable region | Hullo | WO2009098238 SEQ ID NO: 18 | 4232 |
| AD1145 | TrkA | Light chain variable region | 3-23*01 | WO2009098238 SEQ ID NO: 19 | 4233 |
| AD1146 | TrkA | Light chain variable region | JH4 | WO2009098238 SEQ ID NO: 20 | 4234 |
| AD1147 | TrkA | Light chain variable region | L6*01 | WO2009098238 SEQ ID NO: 21 | 4235 |
| AD1148 | TrkA | Light chain variable region | JK1 | WO2009098238 SEQ ID NO: 22 | 4236 |
| AD1149 | TrkA | Light chain variable region | BXhVH5VL1 N297A i | WO2009098238 SEQ ID NO: 23 | 4237 |
| AD1150 | NOGO | Light chain variable region humanized construct L11 | 2A10 construct | WO2007003421 SEQ ID NO: 78 | 3375 |
| AD1151 | NOGO | Light chain variable region humanized construct L13 | 2A10 construct | WO2007003421 SEQ ID NO: 20 | 3376 |
| AD1152 | NOGO | Light chain variable region humanized construct L14 | 2A10 construct | WO2007003421 SEQ ID NO: 21 | 3377 |
| AD1153 | NOGO | Light chain variable region humanized construct L15 | 2A10 construct | WO2007003421 SEQ ID NO: 22 | 3378 |
| AD1154 | NOGO | Light chain variable region humanized construct L16 | 2A10 construct | WO2007003421 SEQ ID NO: 23 | 3379 |
| AD1155 | NOGO | Light chain variable region humanized construct L17 | 2A10 construct | WO2007003421 SEQ ID NO: 24 | 3380 |
| AD1156 | NOGO | Light chain variable region humanized construct L18 | 2A10 construct | WO2007003421 SEQ ID NO: 25 | 3381 |
| AD1157 | NOGO | Light chain variable region humanized construct L6 | 2A10 construct | WO2007003421 SEQ ID NO: 19 | 3382 |
| AD1158 | beta A4 peptide/Alpha beta 9 | Light chain with leader sequence | Antibody A | WO2007068429 SEQ ID NO: 28 | 4238 |
| AD1159 | Aβ amyloid | Light chain, consensus | | WO2006066089 SEQ ID NO: 38 | 4239 |
| AD1160 | Aβ amyloid | Light chain, consensus | | WO2006066089 SEQ ID NO: 39 | 4240 |
| AD1161 | Aβ amyloid | Light chain, consensus | | WO2006066089 SEQ ID NO: 40 | 4241 |
| AD1162 | Aβ amyloid | Light chain, consensus | | WO2006066089 SEQ ID NO: 41 | 4242 |
| AD1163 | Aβ amyloid | Light chain, consensus | | WO2006066089 SEQ ID NO: 42 | 4243 |
| AD1164 | Aβ amyloid | Light chain, consensus | | WO2006066089 SEQ ID NO: 43 | 4244 |
| AD1165 | Aβ amyloid | Light chain, consensus | | WO2006066089 SEQ ID NO: 44 | 4245 |

TABLE 4-continued

Alzheimer's Disease Antibodies

| Antibody No. | Target | Description | Antibody Name | Reference Information | SEQ ID NO |
|---|---|---|---|---|---|
| AD1166 | Aβ amyloid | Light chain, consensus | | WO2006066089 SEQ ID NO: 45 | 4246 |
| AD1167 | Aβ amyloid | Light chain, consensus | | WO2006066089 SEQ ID NO: 46 | 4247 |
| AD1168 | Aβ amyloid | Light chain, consensus | | WO2006066089 SEQ ID NO: 47 | 4248 |
| AD1169 | Aβ amyloid | Light chain, consensus | | WO2006066089 SEQ ID NO: 48 | 4249 |
| AD1170 | Aβ amyloid | Light chain, consensus | | WO2006066089 SEQ ID NO: 49 | 4250 |
| AD1171 | Aβ amyloid | Light chain, consensus | | WO2006066089 SEQ ID NO: 50 | 4251 |
| AD1172 | Aβ amyloid | Light chain, consensus | | WO2006066089 SEQ ID NO: 51 | 4252 |
| AD1173 | PrPC and/or PrPSc | scFv | | U.S. Pat. No. 8,852,587 SEQ ID NO: 6 | 4253 |
| AD1174 | beta amyloid | scFv | RCK37 | U.S. Pat. No. 8,221,750 SEQ ID NO: 6 | 4254 |
| AD1175 | beta amyloid | scFv | RCK22 | U.S. Pat. No. 8,221,750 SEQ ID NO: 8 | 4255 |
| AD1176 | PrP | | ICSM181c | US20140294844 SEQ ID NO: 6 | 4256 |
| AD1177 | PrPC and/or PrPSc | | | U.S. Pat. No. 8,852,587 SEQ ID NO: 3 | 4257 |
| AD1178 | tau | | | US20140302046 SEQ ID NO: 103 | 4258 |

Huntington's Disease Antibodies

In one embodiment, the payload region of the AAV particle comprises one or more nucleic acid sequences encoding one or more of the Huntington's Disease payload antibody polypeptides listed in Table 5 (HD1-HD245; SEQ ID NO: 29418-2970, 3018-3021, 3031-3046, 3056-3076, 3110-3130, 3132-3160, 3164-3177, 3181-3196, 3242-3246, 3257-3268, 3275-3285, 3315-3336, 3338-3371, 3375-3382, 4259-4267).

TABLE 5

Huntington's Disease Antibodies

| Antibody No. | Target | Description | Antibody Name | Reference Information | SEQ ID NO |
|---|---|---|---|---|---|
| HD1 | amyloid proteins | consensus sequence | M13 g3p, fd g3p, fl g3p | US20150376239 SEQ ID NO: 4 | 2948 |
| HD2 | amyloid proteins | consensus sequence | I2-2 g3p, Ike g3p | US20150376239 SEQ ID NO: 7 | 2949 |
| HD3 | 118-126 of α-synuclein | constant region | IgG1 | US20150259404 SEQ ID NO: 38 | 2950 |
| HD4 | amyloid proteins | Fusion protein | M13 g3p | US20150376239 SEQ ID NO: 1 | 2951 |
| HD5 | amyloid proteins | Fusion protein | Construct 5 | US20150376239 SEQ ID NO: 11 | 2952 |
| HD6 | amyloid proteins | Fusion protein | Construct 6 | US20150376239 SEQ ID NO: 13 | 2953 |
| HD7 | amyloid proteins | Fusion protein | fd N2 | US20150376239 SEQ ID NO: 14 | 2954 |
| HD8 | amyloid proteins | Fusion protein | fl N2 | US20150376239 SEQ ID NO: 15 | 2955 |
| HD9 | amyloid proteins | Fusion protein | M13 N2 | US20150376239 SEQ ID NO: 16 | 2956 |
| HD10 | amyloid proteins | Fusion protein | Ike N2 | US20150376239 SEQ ID NO: 17 | 2957 |
| HD11 | amyloid proteins | Fusion protein | I2-2 N2 | US20150376239 SEQ ID NO: 18 | 2958 |
| HD12 | amyloid proteins | Fusion protein | Ifl N2 | US20150376239 SEQ ID NO: 19 | 2959 |
| HD13 | amyloid proteins | Fusion protein | fd g3p | US20150376239 SEQ ID NO: 2 | 2960 |

TABLE 5-continued

Huntington's Disease Antibodies

| Antibody No. | Target | Description | Antibody Name | Reference Information | SEQ ID NO |
|---|---|---|---|---|---|
| HD14 | amyloid proteins | Fusion protein | Construct 3 | US20150376239 SEQ ID NO: 20 | 2961 |
| HD15 | amyloid proteins | Fusion protein | Construct 3m g3p portion | US20150376239 SEQ ID NO: 24 | 2962 |
| HD16 | amyloid proteins | Fusion protein | Ifl g3p | US20150376239 SEQ ID NO: 29 | 2963 |
| HD17 | amyloid proteins | Fusion protein | fl g3p | US20150376239 SEQ ID NO: 3 | 2964 |
| HD18 | amyloid proteins | Fusion protein | fd g3p | US20150376239 SEQ ID NO: 30 | 2965 |
| HD19 | amyloid proteins | Fusion protein | Construct 8, rs-g3p (Ifl-N1N2)-hIgG1-Fc | US20150376239 SEQ ID NO: 31 | 2966 |
| HD20 | amyloid proteins | Fusion protein | I2-2 g3p | US20150376239 SEQ ID NO: 5 | 2967 |
| HD21 | amyloid proteins | Fusion protein | Ike g3p | US20150376239 SEQ ID NO: 6 | 2968 |
| HD22 | amyloid proteins | Fusion protein | Ifl g3p | US20150376239 SEQ ID NO: 8 | 2969 |
| HD23 | amyloid proteins | Fusion protein | Construct 4 | US20150376239 SEQ ID NO: 9 | 2970 |
| HD24 | amyloids | Heavy chain | #118 | WO2010012004 SEQ ID NO: 11 | 3018 |
| HD25 | amyloids | Heavy chain | #121 | WO2010012004 SEQ ID NO: 13 | 3019 |
| HD26 | amyloids | Heavy chain | #204 | WO2010012004 SEQ ID NO: 16 | 3020 |
| HD27 | amyloids | Heavy chain | #205 | WO2010012004 SEQ ID NO: 18 | 3021 |
| HD28 | NOGO | Heavy chain | H6L13 FL | US20140147435 SEQ ID NO: 27 | 3031 |
| HD29 | NOGO | Heavy chain | H16L16 FL, H16L18 FL | US20140147435 SEQ ID NO: 31 | 3032 |
| HD30 | NOGO | Heavy chain | H18L16 FL | US20140147435 SEQ ID NO: 33 | 3033 |
| HD31 | NOGO | Heavy chain | H19L13 FL, H19L16 FL, H19L18 FL | US20140147435 SEQ ID NO: 92 | 3034 |
| HD32 | NOGO | Heavy chain | H20L13 FL, H20L16 FL, H20L18 FL | US20140147435 SEQ ID NO: 93 | 3035 |
| HD33 | NOGO | Heavy chain | H21L13 FL, H21L16 FL, H21L18 FL | US20140147435 SEQ ID NO: 94 | 3036 |
| HD34 | NOGO | Heavy chain | H25L13 FL, H25L16 FL, H25L18 FL | US20140147435 SEQ ID NO: 98 | 3037 |
| HD35 | Nogo receptor-1 | Heavy chain | 5B10 | US20090215691 SEQ ID NO: 16 | 3038 |
| HD36 | Nogo receptor 1 | Heavy chain | 5B10 | US20090215691 SEQ ID NO: 18 | 3039 |
| HD37 | trk-C (NT-3 trkC ligand) | Heavy chain | 2250 | U.S. Pat. No. 7,615,383 SEQ ID NO: 42 | 3040 |
| HD38 | trk-C (NT-3 trkC ligand) | Heavy chain | 2253 | U.S. Pat. No. 7,615,383 SEQ ID NO: 43 | 3041 |
| HD39 | trk-C (NT-3 trkC ligand) | Heavy chain | 2256 | U.S. Pat. No. 7,615,383 SEQ ID NO: 44 | 3042 |
| HD40 | trk-C (NT-3 trkC ligand) | Heavy chain | 6.1.2 | U.S. Pat. No. 7,615,383 SEQ ID NO: 45 | 3043 |
| HD41 | trk-C (NT-3 trkC ligand) | Heavy chain | 6.4.1 | U.S. Pat. No. 7,615,383 SEQ ID NO: 46 | 3044 |
| HD42 | trk-C (NT-3 trkC ligand) | Heavy chain | 2345 | U.S. Pat. No. 7,615,383 SEQ ID NO: 47 | 3045 |
| HD43 | trk-C (NT-3 trkC ligand) | Heavy chain | 2349 | U.S. Pat. No. 7,615,383 SEQ ID NO: 48 | 3046 |
| HD44 | many | Heavy chain fusion protein | H19L13, H19L16, H19L18, H19L14, H19L15, H19L17, H19L6, H19L11 | U.S. Pat. No. 8,053,569 SEQ ID NO: 25 | 3056 |
| HD45 | many | Heavy chain fusion protein | H20L13, H20L16, H20L18, H20L14, H20L15, H20L17, H20L6, H20L11 | U.S. Pat. No. 8,053,569 SEQ ID NO: 28 | 3057 |
| HD46 | many | Heavy chain fusion protein | H22L13, H22L16, H22L18, H22L14, H22L15, H22L17, H22L6, H22L11 | U.S. Pat. No. 8,053,569 SEQ ID NO: 34 | 3058 |
| HD47 | many - growth factors | Heavy chain fusion protein | H5L11, H6L11, H14L11, H15L11, | U.S. Pat. No. 8,053,569 SEQ ID NO: 24 | 3059 |

TABLE 5-continued

Huntington's Disease Antibodies

| Antibody No. | Target | Description | Antibody Name | Reference Information | SEQ ID NO |
|---|---|---|---|---|---|
| | | | H16L11, H17L11, H18L11, H19L11, H20L11, H21L11, H22L11, H23L11, H24L11, H25L11, H700L11 | | |
| HD48 | NOGO | Heavy chain humanized construct H1 | 2A10 construct | WO2007003421 SEQ ID NO: 79 | 3060 |
| HD49 | NOGO | Heavy chain humanized construct H14 | 2A10 construct | WO2007003421 SEQ ID NO: 29 | 3061 |
| HD50 | NOGO | Heavy chain humanized construct H15 | 2A10 construct | WO2007003421 SEQ ID NO: 30 | 3062 |
| HD51 | NOGO | Heavy chain humanized construct H16 | 2A10 construct | WO2007003421 SEQ ID NO: 31 | 3063 |
| HD52 | NOGO | Heavy chain humanized construct H17 | 2A10 construct | WO2007003421 SEQ ID NO: 32 | 3064 |
| HD53 | NOGO | Heavy chain humanized construct H18 | 2A10 construct | WO2007003421 SEQ ID NO: 33 | 3065 |
| HD54 | NOGO | Heavy chain humanized construct H19 | 2A10 construct | WO2007003421 SEQ ID NO: 92 | 3066 |
| HD55 | NOGO | Heavy chain humanized construct H20 | 2A10 construct | WO2007003421 SEQ ID NO: 93 | 3067 |
| HD56 | NOGO | Heavy chain humanized construct H21 | 2A10 construct | WO2007003421 SEQ ID NO: 94 | 3068 |
| HD57 | NOGO | Heavy chain humanized construct H22 | 2A10 construct | WO2007003421 SEQ ID NO: 95 | 3069 |
| HD58 | NOGO | Heavy chain humanized construct H23 | 2A10 construct | WO2007003421 SEQ ID NO: 96 | 3070 |
| HD59 | NOGO | Heavy chain humanized construct H24 | 2A10 construct | WO2007003421 SEQ ID NO: 97 | 3071 |
| HD60 | NOGO | Heavy chain humanized construct H25 | 2A10 construct | WO2007003421 SEQ ID NO: 98 | 3072 |
| HD61 | NOGO | Heavy chain humanized construct H5 | 2A10 construct | WO2007003421 SEQ ID NO: 26 | 3073 |
| HD62 | NOGO | Heavy chain humanized construct H6 | 2A10 construct | WO2007003421 SEQ ID NO: 27 | 3074 |
| HD63 | NOGO | Heavy chain humanized construct H700 | 2A10 construct | WO2007003421 SEQ ID NO: 28 | 3075 |
| HD64 | RTN4 (NOGO) | Heavy chain IgG4, immunomodulator | Atinumab | U.S. Pat. No. 8,163,285 SEQ ID NO: 24 | 3076 |
| HD65 | amyloid oligomers | Heavy chain variable region | F11G3 | U.S. Pat. No. 9,125,846 SEQ ID NO: 11 | 3110 |
| HD66 | DR6 and P75 | Heavy chain variable region | 1P1D6.3 | WO2010062904 SEQ ID NO: 107 | 3116 |
| HD67 | DR6 and P75 | Heavy chain variable region | M50-H01 | WO2010062904 SEQ ID NO: 7 | 3112 |
| HD68 | DR6 and P75 | Heavy chain variable region | M67-G02 | WO2010062904 SEQ ID NO: 77 | 3113 |
| HD69 | DR6 and P75 | Heavy chain variable region | M72-F03 | WO2010062904 SEQ ID NO: 87 | 3114 |
| HD70 | DR6 and P75 | Heavy chain variable region | M73-C04 | WO2010062904 SEQ ID NO: 97 | 3115 |
| HD71 | DR6 and P75 | Heavy chain variable region | 1P2F2.1 | WO2010062904 SEQ ID NO: 117 | 3117 |
| HD72 | DR6 and P75 | Heavy chain variable region | 1P5D10.2 | WO2010062904 SEQ ID NO: 127 | 3118 |
| HD73 | DR6 and P75 | Heavy chain variable region | M51-H09 | WO2010062904 SEQ ID NO: 17 | 3119 |

TABLE 5-continued

Huntington's Disease Antibodies

| Antibody No. | Target | Description | Antibody Name | Reference Information | SEQ ID NO |
|---|---|---|---|---|---|
| HD74 | DR6 and P75 | Heavy chain variable region | M53-E04 | WO2010062904 SEQ ID NO: 27 | 3120 |
| HD75 | DR6 and P75 | Heavy chain variable region | M53-F04 | WO2010062904 SEQ ID NO: 37 | 3121 |
| HD76 | DR6 and P75 | Heavy chain variable region | M62-B02 | WO2010062904 SEQ ID NO: 47 | 3122 |
| HD77 | DR6 and P75 | Heavy chain variable region | M63-E10 | WO2010062904 SEQ ID NO: 57 | 3123 |
| HD78 | DR6 and P75 | Heavy chain variable region | M66-B03 | WO2010062904 SEQ ID NO: 67 | 3111 |
| HD79 | LPG (lyso-phosphatidyl-glucoside) | Heavy chain variable region | #7 | U.S. Pat. No. 8,591,902 SEQ ID NO: 18 | 3124 |
| HD80 | LPG (lyso-phosphatidyl-glucoside) | Heavy chain variable region | #15 | U.S. Pat. No. 8,591,902 SEQ ID NO: 8 | 3125 |
| HD81 | MAG | Heavy chain variable region | | U.S. Pat. No. 8,071,731 SEQ ID NO: 13 | 3126 |
| HD82 | MAG | Heavy chain variable region | | U.S. Pat. No. 8,071,731 SEQ ID NO: 14 | 3127 |
| HD83 | MAG | Heavy chain variable region | | U.S. Pat. No. 8,071,731 SEQ ID NO: 15 | 3128 |
| HD84 | MAI (myelin associated inhibitor) | Heavy chain variable region | | WO2013158748 SEQ ID NO: 1 | 3129 |
| HD85 | MAI (myelin associated inhibitor) | Heavy chain variable region | | WO2013158748 SEQ ID NO: 17 | 3130 |
| HD86 | NOGO | Heavy chain variable region | H5L13, H5L16, H5L18, H5L14, H5L15, H5L17, H5L6, H5L11 | US20140147435 SEQ ID NO: 11 | 3132 |
| HD87 | NOGO | Heavy chain variable region | H6L13, H6L16, H6L18, H6L14, H6L15, H6L17, H6L6 | US20140147435 SEQ ID NO: 12 | 3133 |
| HD88 | NOGO | Heavy chain variable region | H700L13, H700L16, H700L18, H700L14, H700L15, H700L17, H700L6, H700L11 | US20140147435 SEQ ID NO: 13 | 3134 |
| HD89 | NOGO | Heavy chain variable region | H14L13, H14L16, H14L18, H14L14, H14L15, H14L17, H14L6, H14L11 | US20140147435 SEQ ID NO: 14 | 3135 |
| HD90 | NOGO | Heavy chain variable region | H15L13, H15L16, H15L18, H15L14, H15L15, H15L17, H15L6, H15L11 | US20140147435 SEQ ID NO: 15 | 3136 |
| HD91 | NOGO | Heavy chain variable region | H16L13, H16L16, H16L18, H16L14, H16L15, H16L17, H16L6, H16L11 | US20140147435 SEQ ID NO: 16 | 3137 |
| HD92 | NOGO | Heavy chain variable region | H17L13, H17L16, H17L18, H17L14, H17L15, H17L17, H17L6, H17L11 | US20140147435 SEQ ID NO: 17 | 3138 |
| HD93 | NOGO | Heavy chain variable region | H18L13, H18L16, H18L18, H18L14, H18L15, H18L17, H18L6, H18L11 | US20140147435 SEQ ID NO: 18 | 3139 |
| HD94 | NOGO | Heavy chain variable region | H1L13, H1L16, H1L18, H1L14, H1L15, H1L17, H1L6 | US20140147435 SEQ ID NO: 77 | 3140 |
| HD95 | NOGO | Heavy chain variable region | H19L13, H19L16, H19L18, H19L14, H19L15, H19L17, H19L6, H19L11 | US20140147435 SEQ ID NO: 85 | 3141 |
| HD96 | NOGO | Heavy chain variable region | H20L13, H20L16, H20L18, H20L14, H20L15, H20L17, H20L6, H20L11 | US20140147435 SEQ ID NO: 86 | 3142 |
| HD97 | NOGO | Heavy chain variable region | H21L13, H21L16, H21L18, H21L14, H21L15, H21L17, H21L6, H21L11 | US20140147435 SEQ ID NO: 87 | 3143 |

TABLE 5-continued

| Huntington's Disease Antibodies | | | | | |
|---|---|---|---|---|---|
| Antibody No. | Target | Description | Antibody Name | Reference Information | SEQ ID NO |
| HD98 | NOGO | Heavy chain variable region | H22L13, H22L16, H22L18, H22L14, H22L15, H22L17, H22L6, H22L11 | US20140147435 SEQ ID NO: 88 | 3144 |
| HD99 | NOGO | Heavy chain variable region | H23L13, H23L16, H23L18, H23L14, H23L15, H23L17, H23L6, H23L11 | US20140147435 SEQ ID NO: 89 | 3145 |
| HD100 | NOGO | Heavy chain variable region | H24L13, H24L16, H24L18, H24L14, H24L15, H24L17, H24L6, H24L11 | US20140147435 SEQ ID NO: 90 | 3146 |
| HD101 | NOGO | Heavy chain variable region | H25L13, H25L16, H25L18, H25L14, H25L15, H25L17, H25L6, H25L11 | US20140147435 SEQ ID NO: 91 | 3147 |
| HD102 | Nogo-66 | Heavy chain variable region | Antibody clone 50 | US20140065155 SEQ ID NO: 3 | 3148 |
| HD103 | Nogo-66 | Heavy chain variable region | Antibody clone 51 | US20140065155 SEQ ID NO: 5 | 3149 |
| HD104 | NogoA/NiG | Heavy chain variable region | 6A3-Ig4 | WO2009056509 SEQ ID NO: 24 | 3150 |
| HD105 | NogoA/NiG | Heavy chain variable region | 6A3-IgG1 | WO2009056509 SEQ ID NO: 4 | 3151 |
| HD106 | RGM A | Heavy chain variable region | 5F9.1-GL | US20150183871 SEQ ID NO: 35 | 3152 |
| HD107 | RGM A | Heavy chain variable region | 5F9.2-GL | US20150183871 SEQ ID NO: 36 | 3153 |
| HD108 | RGM A | Heavy chain variable region | 5F9.3-GL | US20150183871 SEQ ID NO: 37 | 3154 |
| HD109 | RGM A | Heavy chain variable region | 5F9.4-GL | US20150183871 SEQ ID NO: 38 | 3155 |
| HD110 | RGM A | Heavy chain variable region | 5F9.5-GL | US20150183871 SEQ ID NO: 39 | 3156 |
| HD111 | RGM A | Heavy chain variable region | 5F9.6-GL | US20150183871 SEQ ID NO: 40 | 3157 |
| HD112 | RGM A | Heavy chain variable region | 5F9.7-GL | US20150183871 SEQ ID NO: 41 | 3158 |
| HD113 | RGM A | Heavy chain variable region | 5F9.8-GL | US20150183871 SEQ ID NO: 42 | 3159 |
| HD114 | RGM A | Heavy chain variable region | 5F9.9-GL | US20150183871 SEQ ID NO: 43 | 3160 |
| HD115 | RGM A | Heavy chain variable region | h5F9.1, h5F9.1, h5F9.1, h5F9.1, h5F9.1, h5F9.2, h5F9.3 | US2015/0183871 SEQ ID NO: 47 | 4259 |
| HD116 | RGM A | Heavy chain variable region | h5F9.3, h5F9.9, h5F9.25 | US2015/0183871 SEQ ID NO: 53 | 4260 |
| HD117 | RGM A | Heavy chain variable region | h5F9.4, h5F9.10, h5F9.26 | US2015/0183871 SEQ ID NO: 54 | 4261 |
| HD118 | RGMa | Heavy chain variable region | AE12-21 | US20140023659 SEQ ID NO: 115 | 3166 |
| HD119 | RGMa | Heavy chain variable region | AE12-23 | US20140023659 SEQ ID NO: 123 | 3167 |
| HD120 | RGMa | Heavy chain variable region | AE12-24 | US20140023659 SEQ ID NO: 131 | 3168 |
| HD121 | RGMa | Heavy chain variable region | AE12-3 | US20140023659 SEQ ID NO: 17 | 3169 |
| HD122 | RGMa | Heavy chain variable region | AE12-4 | US20140023659 SEQ ID NO: 25 | 3170 |
| HD123 | RGMa | Heavy chain variable region | AE12-5 | US20140023659 SEQ ID NO: 33 | 3171 |
| HD124 | RGMa | Heavy chain variable region | AE12-6 | US20140023659 SEQ ID NO: 41 | 3172 |
| HD125 | RGMa | Heavy chain variable region | AE12-7 | US20140023659 SEQ ID NO: 49 | 3173 |
| HD126 | RGMa | Heavy chain variable region | AE12-8 | US20140023659 SEQ ID NO: 57 | 3174 |
| HD127 | RGMa | Heavy chain variable region | AE12-2 | US20140023659 SEQ ID NO: 9 | 3175 |
| HD128 | RGMa | Heavy chain variable region | AE12-13 | US20140023659 SEQ ID NO: 91 | 3176 |
| HD129 | RGMa | Heavy chain variable region | AE12-15 | US20140023659 SEQ ID NO: 99 | 3177 |

TABLE 5-continued

Huntington's Disease Antibodies

| Antibody No. | Target | Description | Antibody Name | Reference Information | SEQ ID NO |
|---|---|---|---|---|---|
| HD130 | RGMa | Heavy chain variable region | AE12-1 | US20140023659 SEQ ID NO: 1 | 3164 |
| HD131 | RGMa | Heavy chain variable region | AE12-20 | US20140023659 SEQ ID NO: 107 | 3165 |
| HD132 | NOGO | Heavy chain variable region humanized construct H1 | 2A10 construct | WO2007003421 SEQ ID NO: 77 | 3181 |
| HD133 | NOGO | Heavy chain variable region humanized construct H14 | 2A10 construct | WO2007003421 SEQ ID NO: 14 | 3182 |
| HD134 | NOGO | Heavy chain variable region humanized construct H15 | 2A10 construct | WO2007003421 SEQ ID NO: 15 | 3183 |
| HD135 | NOGO | Heavy chain variable region humanized construct H16 | 2A10 construct | WO2007003421 SEQ ID NO: 16 | 3184 |
| HD136 | NOGO | Heavy chain variable region humanized construct H17 | 2A10 construct | WO2007003421 SEQ ID NO: 17 | 3185 |
| HD137 | NOGO | Heavy chain variable region humanized construct H18 | 2A10 construct | WO2007003421 SEQ ID NO: 18 | 3186 |
| HD138 | NOGO | Heavy chain variable region humanized construct H19 | 2A10 construct | WO2007003421 SEQ ID NO: 85 | 3187 |
| HD139 | NOGO | Heavy chain variable region humanized construct H20 | 2A10 construct | WO2007003421 SEQ ID NO: 86 | 3188 |
| HD140 | NOGO | Heavy chain variable region humanized construct H21 | 2A10 construct | WO2007003421 SEQ ID NO: 87 | 3189 |
| HD141 | NOGO | Heavy chain variable region humanized construct H22 | 2A10 construct | WO2007003421 SEQ ID NO: 88 | 3190 |
| HD142 | NOGO | Heavy chain variable region humanized construct H23 | 2A10 construct | WO2007003421 SEQ ID NO: 89 | 3191 |
| HD143 | NOGO | Heavy chain variable region humanized construct H24 | 2A10 construct | WO2007003421 SEQ ID NO: 90 | 3192 |
| HD144 | NOGO | Heavy chain variable region humanized construct H25 | 2A10 construct | WO2007003421 SEQ ID NO: 91 | 3193 |
| HD145 | NOGO | Heavy chain variable region humanized construct H5 | 2A10 construct | WO2007003421 SEQ ID NO: 11 | 3194 |
| HD146 | NOGO | Heavy chain variable region humanized construct H6 | 2A10 construct | WO2007003421 SEQ ID NO: 12 | 3195 |
| HD147 | NOGO | Heavy chain variable region humanized construct H700 | 2A10 construct | WO2007003421 SEQ ID NO: 13 | 3196 |
| HD148 | amyloids | Light chain | #118 | WO2010012004 SEQ ID NO: 10 | 3242 |
| HD149 | amyloids | Light chain | #121 | WO2010012004 SEQ ID NO: 12 | 3243 |
| HD150 | amyloids | Light chain | #201 | WO2010012004 SEQ ID NO: 14 | 3244 |

TABLE 5-continued

Huntington's Disease Antibodies

| Antibody No. | Target | Description | Antibody Name | Reference Information | SEQ ID NO |
|---|---|---|---|---|---|
| HD151 | amyloids | Light chain | #204 | WO2010012004 SEQ ID NO: 15 | 3245 |
| HD152 | amyloids | Light chain | #205 | WO2010012004 SEQ ID NO: 17 | 3246 |
| HD153 | NOGO | Light chain | H6L13 FL, H19L13 FL, H20L13 FL, H21L13 FL, H25L13 FL | US20140147435 SEQ ID NO: 35 | 3257 |
| HD154 | NOGO | Light chain | H16L16 FL, H19L16 FL, H20L16 FL, H21L16 FL, H25L16 FL, H18L16 FL | US20140147435 SEQ ID NO: 38 | 3258 |
| HD155 | NOGO | Light chain | H16L18 FL, H19L18 FL, H20L18 FL, H21L18 FL, H25L18 FL | US20140147435 SEQ ID NO: 40 | 3259 |
| HD156 | Nogo receptor-1 | Light chain | 7E11 | US20090215691 SEQ ID NO: 15 | 3260 |
| HD157 | Nogo receptor-1 | Light chain | 7E11 | US20090215691 SEQ ID NO: 17 | 3261 |
| HD158 | trk-C (NT-3 trkC ligand) | Light chain | 2250 | U.S. Pat. No. 7,615,383 SEQ ID NO: 49 | 3262 |
| HD159 | trk-C (NT-3 trkC ligand) | Light chain | 2253 | U.S. Pat. No. 7,615,383 SEQ ID NO: 50 | 3263 |
| HD160 | trk-C (NT-3 trkC ligand) | Light chain | 2256 | U.S. Pat. No. 7,615,383 SEQ ID NO: 51 | 3264 |
| HD161 | trk-C (NT-3 trkC ligand) | Light chain | 6.1.2 | U.S. Pat. No. 7,615,383 SEQ ID NO: 52 | 3265 |
| HD162 | trk-C (NT-3 trkC ligand) | Light chain | 6.4.1 | U.S. Pat. No. 7,615,383 SEQ ID NO: 53 | 3266 |
| HD163 | trk-C (NT-3 trkC ligand) | Light chain | 2345 | U.S. Pat. No. 7,615,383 SEQ ID NO: 54 | 3267 |
| HD164 | trk-C (NT-3 trkC ligand) | Light chain | 2349 | U.S. Pat. No. 7,615,383 SEQ ID NO: 55 | 3268 |
| HD165 | many | Light chain fusion protein | H21L13, H21L16, H21L18, H21L14, H21L15, H21L17, H21L6, H21L11 | U.S. Pat. No. 8,053,569 SEQ ID NO: 31 | 3275 |
| HD166 | many | Light chain fusion protein | H23L13, H23L16, H23L18, H23L14, H23L15, H23L17, H23L6, H23L11 | U.S. Pat. No. 8,053,569 SEQ ID NO: 36 | 3276 |
| HD167 | NOGO | Light chain humanized construct L11 | 2A10 construct | WO2007003421 SEQ ID NO: 80 | 3277 |
| HD168 | NOGO | Light chain humanized construct L13 | 2A10 construct | WO2007003421 SEQ ID NO: 35 | 3278 |
| HD169 | NOGO | Light chain humanized construct L14 | 2A10 construct | WO2007003421 SEQ ID NO: 36 | 3279 |
| HD170 | NOGO | Light chain humanized construct L15 | 2A10 construct | WO2007003421 SEQ ID NO: 37 | 3280 |
| HD171 | NOGO | Light chain humanized construct L16 | 2A10 construct | WO2007003421 SEQ ID NO: 38 | 3281 |
| HD172 | NOGO | Light chain humanized construct L17 | 2A10 construct | WO2007003421 SEQ ID NO: 39 | 3282 |
| HD173 | NOGO | Light chain humanized construct L18 | 2A10 construct | WO2007003421 SEQ ID NO: 40 | 3283 |
| HD174 | NOGO | Light chain humanized construct L6 | 2A10 construct | WO2007003421 SEQ ID NO: 34 | 3284 |
| HD175 | RTN4 | Light chain IgG4, immunomodulator | Atinumab | U.S. Pat. No. 8,163,285 SEQ ID NO: 25 | 3285 |
| HD176 | huntingtin protein | Light chain single domain | | US20050226863 SEQ ID NO: 1 | 4262 |
| HD177 | huntingtin protein | Light chain single domain | VL12.3 | US20050226863 SEQ ID NO: 10 | 4263 |
| HD178 | huntingtin protein | Light chain single domain | | US20050226863 SEQ ID NO: 2 | 4264 |

TABLE 5-continued

| Huntington's Disease Antibodies | | | | | |
|---|---|---|---|---|---|
| Antibody No. | Target | Description | Antibody Name | Reference Information | SEQ ID NO |
| HD179 | huntingtin protein | Light chain single domain | | US20050226863 SEQ ID NO: 3 | 4265 |
| HD180 | huntingtin protein | Light chain single domain | | US20050226863 SEQ ID NO: 4 | 4266 |
| HD181 | amyloid oligomers | Light chain variable region | F11G3 | U.S. Pat. No. 9,125,846 SEQ ID NO: 12 | 3315 |
| HD182 | DR6 and P75 | Light chain variable region | M73-C04 | WO2010062904 SEQ ID NO: 102 | 3316 |
| HD183 | DR6 and P75 | Light chain variable region | 1P1D6.3 | WO2010062904 SEQ ID NO: 112 | 3317 |
| HD184 | DR6 and P75 | Light chain variable region | M50-H02 | WO2010062904 SEQ ID NO: 12 | 3318 |
| HD185 | DR6 and P75 | Light chain variable region | 1P2F2.1 | WO2010062904 SEQ ID NO: 122 | 3319 |
| HD186 | DR6 and P75 | Light chain variable region | 1P5D10.2 | WO2010062904 SEQ ID NO: 132 | 3320 |
| HD187 | DR6 and P75 | Light chain variable region | M51-H09 | WO2010062904 SEQ ID NO: 22 | 3321 |
| HD188 | DR6 and P75 | Light chain variable region | M53-E04 | WO2010062904 SEQ ID NO: 32 | 3322 |
| HD189 | DR6 and P75 | Light chain variable region | M53-F04 | WO2010062904 SEQ ID NO: 42 | 3323 |
| HD190 | DR6 and P75 | Light chain variable region | M62-B02 | WO2010062904 SEQ ID NO: 52 | 3324 |
| HD191 | DR6 and P75 | Light chain variable region | M63-E10 | WO2010062904 SEQ ID NO: 62 | 3325 |
| HD192 | DR6 and P75 | Light chain variable region | M66-B03 | WO2010062904 SEQ ID NO: 72 | 3326 |
| HD193 | DR6 and P75 | Light chain variable region | M67-G02 | WO2010062904 SEQ ID NO: 82 | 3327 |
| HD194 | DR6 and P75 | Light chain variable region | M72-F03 | WO2010062904 SEQ ID NO: 92 | 3328 |
| HD195 | LPG (lyso-phosphatidyl-glucoside) | Light chain variable region | #7 | U.S. Pat. No. 8,591,902 SEQ ID NO: 17 | 3329 |
| HD196 | LPG (lyso-phosphatidyl-glucoside) | Light chain variable region | #15 | U.S. Pat. No. 8,591,902 SEQ ID NO: 7 | 3330 |
| HD197 | MAG | Light chain variable region | | U.S. Pat. No. 8,071,731 SEQ ID NO: 16 | 3331 |
| HD198 | MAG | Light chain variable region | | U.S. Pat. No. 8,071,731 SEQ ID NO: 17 | 3332 |
| HD199 | MAG | Light chain variable region | | U.S. Pat. No. 8,071,731 SEQ ID NO: 18 | 3333 |
| HD200 | MAG | Light chain variable region | | U.S. Pat. No. 8,071,731 SEQ ID NO: 19 | 3334 |
| HD201 | MAI (myelin associated inhibitor) | Light chain variable region | | WO2013158748 SEQ ID NO: 11 | 3335 |
| HD202 | MAI (myelin associated inhibitor) | Light chain variable region | | WO2013158748 SEQ ID NO: 27 | 3336 |
| HD203 | NOGO | Light chain variable region | H1L6, H5L6, H6L6, H14L6, H15L6, H16L6, H17L6, H18L6, H19L6, H20L6, H21L6, H22L6, H23L6, H24L6, H25L6, H700L6 | US20140147435 SEQ ID NO: 19 | 3338 |
| HD204 | NOGO | Light chain variable region | H1L13, H5L13, H6L13, H14L13, H15L13, H16L13, H17L13, H18L13, H19L13, H20L13, H21L13, H22L13, H23L13, H24L13, H25L13, H700L13 | US20140147435 SEQ ID NO: 20 | 3339 |
| HD205 | NOGO | Light chain variable region | H1L14, H5L14, H6L14, H14L14, H15L14, H16L14, H17L14, H18L14, H19L14, H20L14, | US20140147435 SEQ ID NO: 21 | 3340 |

TABLE 5-continued

Huntington's Disease Antibodies

| Antibody No. | Target | Description | Antibody Name | Reference Information | SEQ ID NO |
|---|---|---|---|---|---|
| HD206 | NOGO | Light chain variable region | H21L14, H22L14, H23L14, H24L14, H25L14, H700L14 H1L15, H5L15, H6L15, H14L15, H15L15, H16L15, H17L15, H18L15, H19L15, H20L15, H21L15, H22L15, H23L15, H24L15, H25L15, H700L15 | US20140147435 SEQ ID NO: 22 | 3341 |
| HD207 | NOGO | Light chain variable region | H1L16, H5L16, H6L16, H14L16, H15L16, H16L16, H17L16, H18L16, H19L16, H20L16, H21L16, H22L16, H23L16, H24L16, H25L16, H700L16 | US20140147435 SEQ ID NO: 23 | 3342 |
| HD208 | NOGO | Light chain variable region | H1L17, H5L17, H6L17, H14L17, H15L17, H16L17, H17L17, H18L17, H19L17, H20L17, H21L17, H22L17, H23L17, H24L17, H25L17, H700L17 | US20140147435 SEQ ID NO: 24 | 3343 |
| HD209 | NOGO | Light chain variable region | H1L18, H5L18, H6L18, H14L18, H15L18, H16L18, H17L18, H18L18, H19L18, H20L18, H21L18 H22L18, H23L18, H24L18, H25L18, H700L18 | US20140147435 SEQ ID NO: 25 | 3344 |
| HD210 | NOGO | Light chain variable region | H5L11, H6L11, H14L11, H15L11, H16L11, H17L11, H18L11, H19L11, H20L11, H21L11, H22L11, H23L11, H24L11, H25L11, H700L11 | US20140147435 SEQ ID NO: 78 | 3345 |
| HD211 | Nogo-66 | Light chain variable region | Antibody clone 50 | US20140065155 SEQ ID NO: 4 | 3346 |
| HD212 | Nogo-66 | Light chain variable region | Antibody clone 51 | US20140065155 SEQ ID NO: 6 | 3347 |
| HD213 | NogoA/NiG | Light chain variable region | 6A3-Ig4 | WO2009056509 SEQ ID NO: 25 | 3348 |
| HD214 | NogoA/NiG | Light chain variable region | 6A3-IgG1 | WO2009056509 SEQ ID NO: 5 | 3349 |
| HD215 | RGM A | Light chain variable region | 5F9.1-GL, 5F9.1-GL, 5F9.1-GL, 5F9.1-GL, 5F9.1-GL, 5F9.1-GL, 5F9.1-GL, 5F9.1-GL, 5F9.1-GL, 5F9.1-GL, h5F9.4, h5F9.11, h5F9.12 | US20150183871 SEQ ID NO: 44 | 3350 |
| HD216 | RGM A | Light chain variable region | 5F9.2-GL, 5F9.2-GL, 5F9.2-GL, 5F9.2-GL, 5F9.2-GL, 5F9.2-GL, 5F9.2-GL, 5F9.2-GL, 5F9.2-GL, 5F9.2-GL, h5F9.5, h5F9.19, h5F9.20 | US20150183871 SEQ ID NO: 45 | 3351 |
| HD217 | RGM A | Light chain variable region | 5F9.3-GL, 5F9.3-GL, 5F9.3-GL, 5F9.3-GL, 5F9.3-GL, 5F9.3-GL, 5F9.3-GL, 5F9.3-GL, 5F9.3-GL, 5F9.3-GL, h5F9.6, h5F9.21, h5F9.22 | US20150183871 SEQ ID NO: 46 | 3352 |
| HD218 | RGM A | Light chain variable region | h5F9.5, h5F9.6, h5F9.7, h5F9.8, h5F9.9, h5F9.10 | US20150183871 SEQ ID NO: 48 | 3353 |

TABLE 5-continued

Huntington's Disease Antibodies

| Antibody No. | Target | Description | Antibody Name | Reference Information | SEQ ID NO |
|---|---|---|---|---|---|
| HD219 | RGM A | Light chain variable region | h5F9.11, h5F9.19, h5F9.21 | US20150183871 SEQ ID NO: 49 | 3354 |
| HD220 | RGM A | Light chain variable region | h5F9.12, h5F9.20, h5F9.22, h5F9.23, h5F9.25, h5F9.25, h5F9.26 | US20150183871 SEQ ID NO: 50 | 3355 |
| HD221 | RGM A | Light chain variable region | h5F9.1, h5F9.7, h5F9.23 | US20150183871 SEQ ID NO: 51 | 3356 |
| HD222 | RGM A | Light chain variable region | h5F9.2, h5F9.8, h5F9.25 | US20150183871 SEQ ID NO: 52 | 3357 |
| HD223 | RGMa | Light chain variable region | AE12-15 | US20140023659 SEQ ID NO: 103 | 3358 |
| HD224 | RGMa | Light chain variable region | AE12-20 | US20140023659 SEQ ID NO: 111 | 3359 |
| HD225 | RGMa | Light chain variable region | AE12-21 | US20140023659 SEQ ID NO: 119 | 3360 |
| HD226 | RGMa | Light chain variable region | AE12-23 | US20140023659 SEQ ID NO: 127 | 3361 |
| HD227 | RGMa | Light chain variable region | AE12-2 | US20140023659 SEQ ID NO: 13 | 3362 |
| HD228 | RGMa | Light chain variable region | AE12-24 | US20140023659 SEQ ID NO: 135 | 3363 |
| HD229 | RGMa | Light chain variable region | AE12-3 | US20140023659 SEQ ID NO: 21 | 3364 |
| HD230 | RGMa | Light chain variable region | AE12-4 | US20140023659 SEQ ID NO: 29 | 3365 |
| HD231 | RGMa | Light chain variable region | AE12-5 | US20140023659 SEQ ID NO: 37 | 3366 |
| HD232 | RGMa | Light chain variable region | AE12-6 | US20140023659 SEQ ID NO: 45 | 3367 |
| HD233 | RGMa | Light chain variable region | AE12-1 | US20140023659 SEQ ID NO: 5 | 3368 |
| HD234 | RGMa | Light chain variable region | AE12-7 | US20140023659 SEQ ID NO: 53 | 3369 |
| HD235 | RGMa | Light chain variable region | AE12-8 | US20140023659 SEQ ID NO: 61 | 3370 |
| HD236 | RGMa | Light chain variable region | AE12-13 | US20140023659 SEQ ID NO: 95 | 3371 |
| HD237 | NOGO | Light chain variable region humanized construct L11 | 2A10 construct | WO2007003421 SEQ ID NO: 78 | 3375 |
| HD238 | NOGO | Light chain variable region humanized construct L13 | 2A10 construct | WO2007003421 SEQ ID NO: 20 | 3376 |
| HD239 | NOGO | Light chain variable region humanized construct L14 | 2A10 construct | WO2007003421 SEQ ID NO: 21 | 3377 |
| HD240 | NOGO | Light chain variable region humanized construct L15 | 2A10 construct | WO2007003421 SEQ ID NO: 22 | 3378 |
| HD241 | NOGO | Light chain variable region humanized construct L16 | 2A10 construct | WO2007003421 SEQ ID NO: 23 | 3379 |
| HD242 | NOGO | Light chain variable region humanized construct L17 | 2A10 construct | WO2007003421 SEQ ID NO: 24 | 3380 |
| HD243 | NOGO | Light chain variable region humanized construct L18 | 2A10 construct | WO2007003421 SEQ ID NO: 25 | 3381 |
| HD244 | NOGO | Light chain variable region humanized construct L6 | 2A10 construct | WO2007003421 SEQ ID NO: 19 | 3382 |
| HD245 | HTT | | | Lecerf, J. M. et al., Human single-chain Fv intrabodies counteract in situ huntingtin aggregation in cellular | 4267 |

TABLE 5-continued

| | | | | | |
|---|---|---|---|---|---|
| | | Huntington's Disease Antibodies | | | |
| Antibody No. | Target | Description | Antibody Name | Reference Information | SEQ ID NO |
| | | | | models of Huntington's disease, Proc. Natl. Acad. Sci. U.S.A. 98 (8), 4764-4769 (2001), NCBI Accession # ACA53373.1 | |

Muscle Disease Antibodies

In one embodiment, the payload region of the AAV particle comprises one or more nucleic acid sequences encoding one or more of the muscle disease payload antibody polypeptides listed in Table 6 (MUS1-MUS485; SEQ ID NO: 2948-2970, 3018-3046, 3056-3076, 3110-3130, 3132-3177, 3181-3196, 3242-3268, 327.5-3285, 3315-3336, 3338-3371, 3375-3382, 4268-4494). A non-exhaustive listing of muscle diseases includes Multiple System Atrophy (MSA), Amyotrophic Lateral Sclerosis (ALS) and Duchenne Muscular Dystrophy (DMD).

TABLE 6

| | | Muscle Disease Antibodies | | | |
|---|---|---|---|---|---|
| Antibody No. | Target | Description | Antibody Name | Reference Information | SEQ ID NO |
| MUS1 | amyloid proteins | consensus sequence | M13 g3p, fd g3p, fl g3p | US20150376239 SEQ ID NO: 4 | 2948 |
| MUS2 | amyloid proteins | consensus sequence | I2-2 g3p, Ike g3p | US20150376239 SEQ ID NO: 7 | 2949 |
| MUS3 | 118-126 of α-synuclein | constant region | IgG1 | US20150259404 SEQ ID NO: 38 | 2950 |
| MUS4 | amyloid proteins | Fusion protein | M13 g3p | US20150376239 SEQ ID NO: 1 | 2951 |
| MUS5 | amyloid proteins | Fusion protein | Construct 5 | US20150376239 SEQ ID NO: 11 | 2952 |
| MUS6 | amyloid proteins | Fusion protein | Construct 6 | US20150376239 SEQ ID NO: 13 | 2953 |
| MUS7 | amyloid proteins | Fusion protein | fd N2 | US20150376239 SEQ ID NO: 14 | 2954 |
| MUS8 | amyloid proteins | Fusion protein | fl N2 | US20150376239 SEQ ID NO: 15 | 2955 |
| MUS9 | amyloid proteins | Fusion protein | M13 N2 | US20150376239 SEQ ID NO: 16 | 2956 |
| MUS10 | amyloid proteins | Fusion protein | Ike N2 | US20150376239 SEQ ID NO: 17 | 2957 |
| MUS11 | amyloid proteins | Fusion protein | I2-2 N2 | US20150376239 SEQ ID NO: 18 | 2958 |
| MUS12 | amyloid proteins | Fusion protein | Ifl N2 | US20150376239 SEQ ID NO: 19 | 2959 |
| MUS13 | amyloid proteins | Fusion protein | fd g3p | US20150376239 SEQ ID NO: 2 | 2960 |
| MUS14 | amyloid proteins | Fusion protein | Construct 3 | US20150376239 SEQ ID NO: 20 | 2961 |
| MUS15 | amyloid proteins | Fusion protein | Construct 3m g3p portion | US20150376239 SEQ ID NO: 24 | 2962 |
| MUS16 | amyloid proteins | Fusion protein | Ifl g3p | US20150376239 SEQ ID NO: 29 | 2963 |
| MUS17 | amyloid proteins | Fusion protein | fl g3p | US20150376239 SEQ ID NO: 3 | 2964 |
| MUS18 | amyloid proteins | Fusion protein | fd g3p | US20150376239 SEQ ID NO: 30 | 2965 |
| MUS19 | amyloid proteins | Fusion protein | Construct 8, rs-g3p (Ifl-N1N2)-hIgG1-Fc | US20150376239 SEQ ID NO: 31 | 2966 |
| MUS20 | amyloid proteins | Fusion protein | I2-2 g3p | US20150376239 SEQ ID NO: 5 | 2967 |
| MUS21 | amyloid proteins | Fusion protein | Ike g3p | US20150376239 SEQ ID NO: 6 | 2968 |
| MUS22 | amyloid proteins | Fusion protein | Ifl g3p | US20150376239 SEQ ID NO: 8 | 2969 |

TABLE 6-continued

Muscle Disease Antibodies

| Antibody No. | Target | Description | Antibody Name | Reference Information | SEQ ID NO |
|---|---|---|---|---|---|
| MUS23 | amyloid proteins | Fusion protein | Construct 4 | US20150376239 SEQ ID NO: 9 | 2970 |
| MUS24 | ACVR2B (SMA - muscle growth) | Heavy chain | H6L4. H6L5, H6L6 | U.S. Pat. No. 8,388,968 SEQ ID NO: 146 | 4268 |
| MUS25 | ACVR2B (SMA - muscle growth) | Heavy chain | | U.S. Pat. No. 8,388,968 SEQ ID NO: 146 | 4269 |
| MUS26 | amyloids | Heavy chain | #118 | WO2010012004 SEQ ID NO: 11 | 3018 |
| MUS27 | amyloids | Heavy chain | #121 | WO2010012004 SEQ ID NO: 13 | 3019 |
| MUS28 | amyloids | Heavy chain | #204 | WO2010012004 SEQ ID NO: 16 | 3020 |
| MUS29 | amyloids | Heavy chain | #205 | WO2010012004 SEQ ID NO: 18 | 3021 |
| MUS30 | EAG1 | Heavy chain | chimeric ImAb3 | WO2006037604 SEQ ID NO: 12 | 3022 |
| MUS31 | EAG1 | Heavy chain | chimeric ImAb4 | WO2006037604 SEQ ID NO: 16 | 3023 |
| MUS32 | EAG1 | Heavy chain | HC-lmAb3-humVH3-72 | WO2006037604 SEQ ID NO: 20 | 3024 |
| MUS33 | EAG1 | Heavy chain | HC-lmAb4-humVH4-59 | WO2006037604 SEQ ID NO: 24 | 3025 |
| MUS34 | EAG1 | Heavy chain | HC-lmAb3-humVH3 23 | WO2006037604 SEQ ID NO: 28 | 3026 |
| MUS35 | EAG1 | Heavy chain | HC-lmAb3-humVH2 26 | WO2006037604 SEQ ID NO: 32 | 3027 |
| MUS36 | EAG1 | Heavy chain | HC-lmAb4-humVH1-3 | WO2006037604 SEQ ID NO: 36 | 3028 |
| MUS37 | EAG1 | Heavy chain | ImAb4 | WO2006037604 SEQ ID NO: 4 | 3029 |
| MUS38 | EAG1 | Heavy chain | ImAb3 | WO2006037604 SEQ ID NO: 8 | 3030 |
| MUS39 | GDF-8 | Heavy chain | 358-22 | US20130287762 SEQ ID NO: 10 | 4270 |
| MUS40 | GDF-8 | Heavy chain | 358-11-M1 | US20130287762 SEQ ID NO: 16 | 4271 |
| MUS41 | GDF-8 | Heavy chain | 358-22-M1 | US20130287762 SEQ ID NO: 4 | 4272 |
| MUS42 | growth differentiation factor 8 | Heavy chain | | | 4273 |
| MUS43 | growth differentiation factor 8 | Heavy chain | Domagrozumab | | 4274 |
| MUS44 | MAG | Heavy chain | | | 4275 |
| MUS45 | MSTN | Heavy chain | H24L13, H24L16, H24L18, H24L14, H24L15, H24L17, H24L6, H24L11 | | 4276 |
| MUS46 | myostatin | Heavy chain | NI-204.11F11 | US20110256132 SEQ ID NO: 26 | 4277 |
| MUS47 | myostatin | Heavy chain | NI-204.67E12 | US20110256132 SEQ ID NO: 28 | 4278 |
| MUS48 | myostatin | Heavy chain | NI-204.6H1 | US20110256132 SEQ ID NO: 29 | 4279 |
| MUS49 | myostatin | Heavy chain | NI-204.6H1 | US20110256132 SEQ ID NO: 30 | 4280 |
| MUS50 | Myostatin | Heavy chain | 312-19, 312-19-M1 | US20130142788 SEQ ID NO: 123 | 4281 |
| MUS51 | Myostatin | Heavy chain | 591-33, 591-33-M1 | US20130142788 SEQ ID NO: 125 | 4282 |
| MUS52 | Myostatin | Heavy chain | 114-41, 114-41-M1 | US20130142788 SEQ ID NO: 127 | 4283 |
| MUS53 | Myostatin | Heavy chain | 595-16, 595-16-M1 | US20130142788 SEQ ID NO: 138 | 4284 |
| MUS54 | Myostatin | Heavy chain | 591-37, 591-37-M1 | US20130142788 SEQ ID NO: 139 | 4285 |
| MUS55 | Myostatin | Heavy chain | 358-11, 358-11-M1 | US20130142788 SEQ ID NO: 140 | 4286 |
| MUS56 | Myostatin | Heavy chain | 358-22, 358-22-M1 | US20130142788 SEQ ID NO: 141 | 4287 |
| MUS57 | Myostatin | Heavy chain | 597-120, 597-120-M1 | US20130142788 SEQ ID NO: 142 | 4288 |

TABLE 6-continued

Muscle Disease Antibodies

| Antibody No. | Target | Description | Antibody Name | Reference Information | SEQ ID NO |
|---|---|---|---|---|---|
| MUS58 | Myostatin | Heavy chain | 311-3 | US20130142788 SEQ ID NO: 143 | 4289 |
| MUS59 | Myostatin | Heavy chain | 311-3-M1 | US20130142788 SEQ ID NO: 144 | 4290 |
| MUS60 | Myostatin | Heavy chain | 312-19-M1 | US20130142788 SEQ ID NO: 26 | 4291 |
| MUS61 | Myostatin | Heavy chain | 114-41 | US20130142788 SEQ ID NO: 30 | 4292 |
| MUS62 | Myostatin | Heavy chain | 311-3-M1 | US20130142788 SEQ ID NO: 35 | 4293 |
| MUS63 | Myostatin | Heavy chain | 312-19 | US20130142788 SEQ ID NO: 36 | 4294 |
| MUS64 | Myostatin | Heavy chain | 591-33 | US20130142788 SEQ ID NO: 38 | 4295 |
| MUS65 | Myostatin | Heavy chain | 591-33-M1 | US20130142788 SEQ ID NO: 39 | 4296 |
| MUS66 | Myostatin | Heavy chain | 312-56 | US20130142788 SEQ ID NO: 98 | 4297 |
| MUS67 | myostatin antagonists | Heavy chain | NI-205.21G2 | US20130209489 SEQ ID NO: 11 | 4298 |
| MUS68 | myostatin antagonists | Heavy chain | NI-205.8A2 | US20130209489 SEQ ID NO: 12 | 4299 |
| MUS69 | myostatin antagonists | Heavy chain | NI-205.8A2 | US20130209489 SEQ ID NO: 13 | 4300 |
| MUS70 | myostatin antagonists | Heavy chain | NI-205.15F12 | US20130209489 SEQ ID NO: 14 | 4301 |
| MUS71 | myostatin antagonists | Heavy chain | NI-205.15F12 | US20130209489 SEQ ID NO: 15 | 4302 |
| MUS72 | myostatin antagonists | Heavy chain | NI-205.113C4 | US20130209489 SEQ ID NO: 16 | 4303 |
| MUS73 | myostatin antagonists | Heavy chain | NI-205.113C4 | US20130209489 SEQ ID NO: 17 | 4304 |
| MUS74 | myostatin antagonists | Heavy chain | NI-205.25F3 | US20130209489 SEQ ID NO: 18 | 4305 |
| MUS75 | myostatin antagonists | Heavy chain | NT-205.25F3 | US20130209489 SEQ ID NO: 19 | 4306 |
| MUS76 | NOGO | Heavy chain | HI9L13 FL, H19L16 FL, H19L18 FL | US20140147435 SEQ ID NO: 92 | 3034 |
| MUS77 | NOGO | Heavy chain | H20L13 FL, H20L16 FL, H20L18 FL | US20140147435 SEQ ID NO: 93 | 3035 |
| MUS78 | NOGO | Heavy chain | H21L13 FL, H21L16 FL, H21L18 FL | US20140147435 SEQ ID NO: 94 | 3036 |
| MUS79 | NOGO | Heavy chain | H25L13 FL, H25L16 FL, H25L18 FL | US20140147435 SEQ ID NO: 98 | 3037 |
| MUS80 | NOGO | Heavy chain | H6L13 FL | US20140147435 SEQ ID NO: 27 | 3031 |
| MUS81 | NOGO | Heavy chain | H16L16 FL, H16L18 FL | US20140147435 SEQ ID NO: 31 | 3032 |
| MUS82 | NOGO | Heavy chain | H18L16 FL | US20140147435 SEQ ID NO: 33 | 3033 |
| MUS83 | Nogo receptor-1 | Heavy chain | 5B10 | US20090215691 SEQ ID NO: 16 | 3038 |
| MUS84 | Nogo receptor-1 | Heavy chain | 5B10 | US20090215691 SEQ ID NO: 18 | 3039 |
| MUS85 | RTN4 | Heavy chain | | SEQ ID NO: 38 U.S. Pat. No. 7,780,964 | 4307 |
| MUS86 | S1P4 | Heavy chain | | WO2015057939 SEQ ID NO: 39 | 4308 |
| MUS87 | trk-C (NT-3 trkC ligand) | Heavy chain | 2250 | U.S. Pat. No. 7,615,383 SEQ ID NO: 42 | 3040 |
| MUS88 | trk-C (NT-3 trkC ligand) | Heavy chain | 2253 | U.S. Pat. No. 7,615,383 SEQ ID NO: 43 | 3041 |
| MUS89 | trk-C (NT-3 trkC ligand) | Heavy chain | 2256 | U.S. Pat. No. 7,615,383 SEQ ID NO: 44 | 3042 |
| MUS90 | trk-C (NT-3 trkC ligand) | Heavy chain | 6.1.2 | U.S. Pat. No. 7,615,383 SEQ ID NO: 45 | 3043 |
| MUS91 | trk-C (NT-3 trkC ligand) | Heavy chain | 6.4.1 | U.S. Pat. No. 7,615,383 SEQ ID NO: 46 | 3044 |
| MUS92 | trk-C (NT-3 trkC ligand) | Heavy chain | 2345 | U.S. Pat. No. 7,615,383 SEQ ID NO: 47 | 3045 |
| MUS93 | trk-C (NT-3 trkC ligand) | Heavy chain | 2349 | U.S. Pat. No. 7,615,383 SEQ ID NO: 48 | 3046 |
| MUS94 | myostatin antagonists | Heavy chain consensus | NI-205.87E7 | US20130209489 SEQ ID NO: 20 | 4309 |

TABLE 6-continued

Muscle Disease Antibodies

| Antibody No. | Target | Description | Antibody Name | Reference Information | SEQ ID NO |
|---|---|---|---|---|---|
| MUS95 | GDF-8 | Heavy chain constant region | | U.S. Pat. No. 8,956,608 SEQ ID NO: 19 | 4310 |
| MUS96 | many - growth factors (to increase transport across BBB) | Heavy chain fusion protein | H19L13, H19L16, H19L18, H19L14, H19L15, H19L17, H19L6, H19L11 | U.S. Pat. No. 8,053,569 SEQ ID NO: 25 | 3056 |
| MUS97 | many - growth factors (to increase transport across BBB) | Heavy chain fusion protein | H20L13, H20L16, H20L18, H20L14, H20L15, H20L17, H20L6, H20L11 | U.S. Pat. No. 8,053,569 SEQ ID NO: 28 | 3057 |
| MUS98 | many - growth factors (to increase transport across BBB) | Heavy chain fusion protein | H22L13, H22L16, H22L18, H22L14, H22L15, H22L17, H22L6, H22L11 | U.S. Pat. No. 8,053,569 SEQ ID NO: 34 | 3058 |
| MUS99 | many - growth factors (to increase transport across BBB) | Heavy chain fusion protein | H5L11, H6L11, H14L11, H15L11, H16L11, H17L11, H18L11, H19L11, H20L11, H21L11, H22L11, H23L11, H24L11, H25L11, H700L11 | U.S. Pat. No. 8,053,569 SEQ ID NO: 24 | 3059 |
| MUS100 | NOGO | Heavy chain humanized construct H1 | 2A10 construct | WO2007003421 SEQ ID NO: 79 | 3060 |
| MUS101 | NOGO | Heavy chain humanized construct H14 | 2A10 construct | WO2007003421 SEQ ID NO: 29 | 3061 |
| MUS102 | NOGO | Heavy chain construct H15 | 2A10 construct | WO2007003421 SEQ ID NO: 30 | 3062 |
| MUS103 | NOGO | Heavy chain humanized construct H16 | 2A10 construct | WO2007003421 SEQ ID NO: 31 | 3063 |
| MUS104 | NOGO | Heavy chain humanized construct H17 | 2A10 construct | WO2007003421 SEQ ID NO: 32 | 3064 |
| MUS105 | NOGO | Heavy chain humanized construct H18 | 2A10 construct | WO2007003421 SEQ ID NO: 33 | 3065 |
| MUS106 | NOGO | Heavy chain construct H19 | 2A10 construct | WO2007003421 SEQ ID NO: 92 | 3066 |
| MUS107 | NOGO | Heavy chain humanized construct H20 | 2A10 construct | WO2007003421 SEQ ID NO: 93 | 3067 |
| MUS108 | NOGO | Heavy chain humanized construct H21 | 2A10 construct | WO2007003421 SEQ ID NO: 94 | 3068 |
| MUS109 | NOGO | Heavy chain humanized construct H22 | 2A10 construct | WO2007003421 SEQ ID NO: 95 | 3069 |
| MUS110 | NOGO | Heavy chain humanized construct H23 | 2A10 construct | WO2007003421 SEQ ID NO: 96 | 3070 |
| MUS111 | NOGO | Heavy chain humanized construct H24 | 2A10 construct | WO2007003421 SEQ ID NO: 97 | 3071 |
| MUS112 | NOGO | Heavy chain humanized construct H25 | 2A10 construct | WO2007003421 SEQ ID NO: 98 | 3072 |
| MUS113 | NOGO | Heavy chain humanized construct H5 | 2A10 construct | WO2007003421 SEQ ID NO: 26 | 3073 |
| MUS114 | NOGO | Heavy chain humanized construct H6 | 2A10 construct | WO2007003421 SEQ ID NO: 27 | 3074 |
| MUS115 | NOGO | Heavy chain construct H700 | 2A10 construct | WO2007003421 SEQ ID NO: 28 | 3075 |
| MUS116 | RTN4 (NOGO) | Heavy chain IgG4, immunomodulator | Atinumab | U.S. Pat. No. 8,163,285 SEQ ID NO: 24 | 3076 |
| MUS117 | amyloid oligomers | Heavy chain variable region | F11G3 | U.S. Pat. No. 9,125,846 SEQ ID NO: 11 | 3110 |

TABLE 6-continued

Muscle Disease Antibodies

| Antibody No. | Target | Description | Antibody Name | Reference Information | SEQ ID NO |
|---|---|---|---|---|---|
| MUS118 | differentiation factor 8 (GDF8) | Heavy chain variable region | H8L4. H8L5, H8L6 | US20140023638 SEQ ID NO: 17 | 4311 |
| MUS119 | DR6 and P75 | Heavy chain variable region | M62-B02 | WO2010062904 SEQ ID NO: 47 | 3122 |
| MUS120 | DR6 and P75 | Heavy chain variable region | M63-E10 | WO2010062904 SEQ ID NO: 57 | 3123 |
| MUS121 | DR6 and P75 | Heavy chain variable region | M66-B03 | WO2010062904 SEQ ID NO: 67 | 3111 |
| MUS122 | DR6 and P75 | Heavy chain variable region | M50-H01 | WO2010062904 SEQ ID NO: 7 | 3112 |
| MUS123 | DR6 and P75 | Heavy chain variable region | M67-G02 | WO2010062904 SEQ ID NO: 77 | 3113 |
| MUS124 | DR6 and P75 | Heavy chain variable region | M72-F03 | WO2010062904 SEQ ID NO: 87 | 3114 |
| MUS125 | DR6 and P75 | Heavy chain variable region | M73-C04 | WO2010062904 SEQ ID NO: 97 | 3115 |
| MUS126 | DR6 and P75 | Heavy chain variable region | 1P1D6.3 | WO2010062904 SEQ ID NO: 107 | 3116 |
| MUS127 | DR6 and P75 | Heavy chain variable region | 1P2F2.1 | WO2010062904 SEQ ID NO: 117 | 3117 |
| MUS128 | DR6 and P75 | Heavy chain variable region | 1P5D10.2 | WO2010062904 SEQ ID NO: 127 | 3118 |
| MUS129 | DR6 and P75 | Heavy chain variable region | M51-H09 | WO2010062904 SEQ ID NO: 17 | 3119 |
| MUS130 | DR6 and P75 | Heavy chain variable region | M53-E04 | WO2010062904 SEQ ID NO: 27 | 3120 |
| MUS131 | DR6 and P75 | Heavy chain variable region | M53-F04 | WO2010062904 SEQ ID NO: 37 | 3121 |
| MUS132 | GDF-8 | Heavy chain variable region | 595-16 | U.S. Pat. No. 8,956,608 SEQ ID NO: 26 | 4312 |
| MUS133 | GDF-8 | Heavy chain variable region | 12A5-10HC | U.S. Pat. No. 8,956,608 SEQ ID NO: 7 | 4313 |
| MUS134 | growth differentiation factor 8 | Heavy chain variable region | | U.S. Pat. No. 8,840,894 SEQ ID NO: 360 | 4314 |
| MUS135 | LPG (lyso-phosphatidyl-glucoside) | Heavy chain variable region | #7 | U.S. Pat. No. 8,591,902 SEQ ID NO: 18 | 3124 |
| MUS136 | LPG (lyso-phosphatidyl-glucoside) | Heavy chain variable region | #15 | U.S. Pat. No. 8,591,902 SEQ ID NO: 8 | 3125 |
| MUS137 | MAG | Heavy chain variable region | | U.S. Pat. No. 8,071,731 SEQ ID NO: 13 | 3126 |
| MUS138 | MAG | Heavy chain variable region | | U.S. Pat. No. 8,071,731 SEQ ID NO: 14 | 3127 |
| MUS139 | MAG | Heavy chain variable region | | U.S. Pat. No. 8,071,731 SEQ ID NO: 15 | 3128 |
| MUS140 | MAI (myelin associated inhibitor) | Heavy chain variable region | | WO2013158748 SEQ ID NO: 1 | 3129 |
| MUS141 | MAI (myelin associated inhibitor) | Heavy chain variable region | | WO2013158748 SEQ ID NO: 17 | 3130 |
| MUS142 | myostatin | Heavy chain variable region | NI-204.7B3 | SEQ ID 6 WO 2006107611 | 4315 |
| MUS143 | myostatin | Heavy chain variable region | NI-204.10A8 | US20110256132 SEQ ID NO: 14 | 4316 |
| MUS144 | myostatin | Heavy chain variable region | NI-204.10D12 | US20110256132 SEQ ID NO: 19 | 4317 |
| MUS145 | myostatin | Heavy chain variable region | NI-204.10D12 | US20110256132 SEQ ID NO: 20 | 4318 |
| MUS146 | myostatin | Heavy chain variable region | NI-104.12G7 | US20110256132 SEQ ID NO: 22 | 4319 |
| MUS147 | myostatin | Heavy chain variable region | NI-204.10A8 | US20110256132 SEQ ID NO: 23 | 4320 |
| MUS148 | myostatin | Heavy chain variable region | NI-104.12G7 | US20110256132 SEQ ID NO: 25 | 4321 |
| MUS149 | myostatin | Heavy chain variable region | 312-56 | US20110256132 SEQ ID NO: 8 | 4322 |
| MUS150 | NOGO | Heavy chain variable region | H20L13, H20L16, H20L18, H20L14, H20L15, H20L17, H20L6, H20L11 | US20140147435 SEQ ID NO: 86 | 3142 |

TABLE 6-continued

Muscle Disease Antibodies

| Antibody No. | Target | Description | Antibody Name | Reference Information | SEQ ID NO |
|---|---|---|---|---|---|
| MUS151 | NOGO | Heavy chain variable region | H21L13, H21L16, H21L18, H21L14, H21L15, H21L17, H21L6, H21L11 | US20140147435 SEQ ID NO: 87 | 3143 |
| MUS152 | NOGO | Heavy chain variable region | H22L13, H22L16, H22L18, H22L14, H22L15, H22L17, H22L6, H22L11 | US20140147435 SEQ ID NO: 88 | 3144 |
| MUS153 | NOGO | Heavy chain variable region | H23L13, H23L16, H23L18, H23L14, H23L15, H23L17, H23L6, H23L11 | US20140147435 SEQ ID NO: 89 | 3145 |
| MUS154 | NOGO | Heavy chain variable region | H24L13, H24L16, H24L18, H24L14, H24L15, H24L17, H24L6, H24L11 | US20140147435 SEQ ID NO: 90 | 3146 |
| MUS155 | NOGO | Heavy chain variable region | H25L13, H25L16, H25L18, H25L14, H25L15, H25L17, H25L6, H25L11 | US20140147435 SEQ ID NO: 91 | 3147 |
| MUS156 | NOGO | Heavy chain variable region | H5L13, H5L16, H5L18, H5L14, H5L15, H5L17, H5L6, H5L11 | US20140147435 SEQ ID NO: 11 | 3132 |
| MUS157 | NOGO | Heavy chain variable region | H6L13, H6L16, H6L18, H6L14, H6L15, H6L17, H6L6 | US20140147435 SEQ ID NO: 12 | 3133 |
| MUS158 | NOGO | Heavy chain variable region | H700L13, H700L16, H700L18, H700L14, H700L15, H700L17, H700L6, H700L11 | US20140147435 SEQ ID NO: 13 | 3134 |
| MUS159 | NOGO | Heavy chain variable region | H14L13, H14L16, H14L18, H14L14, H14L15, H14L17, H14L6, H14L11 | US20140147435 SEQ ID NO: 14 | 3135 |
| MUS160 | NOGO | Heavy chain variable region | H15L13, H15L16, H15L18, H15L14, H15L15, H15L17, H15L6, H15L11 | US20140147435 SEQ ID NO: 15 | 3136 |
| MUS161 | NOGO | Heavy chain variable region | H16L13, H16L16, H16L18, H16L14, H16L15, H16L17, H16L6, H16L11 | US20140147435 SEQ ID NO: 16 | 3137 |
| MUS162 | NOGO | Heavy chain variable region | H17L13, H17L16, H17L18, H17L14, H17L15, H17L17, H17L6, H17L11 | US20140147435 SEQ ID NO: 17 | 3138 |
| MUS163 | NOGO | Heavy chain variable region | H18L13, H18L16, H18L18, H18L14, H18L15, H18L17, H18L6, H18L11 | US20140147435 SEQ ID NO: 18 | 3139 |
| MUS164 | NOGO | Heavy chain variable region | H1L13, H1L16, H1L18, H1L14, H1L15, H1L17, H1L6 | US20140147435 SEQ ID NO: 77 | 3140 |
| MUS165 | NOGO | Heavy chain variable region | H19L13, H19L16, H19L18, H19L14, H19L15, H19L17, H19L6, H19L11 | US20140147435 SEQ ID NO: 85 | 3141 |
| MUS166 | Nogo-66 | Heavy chain variable region | Antibody clone 50 | US20140065155 SEQ ID NO: 3 | 3148 |
| MUS167 | Nogo-66 | Heavy chain variable region | Antibody clone 51 | US20140065155 SEQ ID NO: 5 | 3149 |
| MUS168 | NogoA/NiG | Heavy chain variable region | 6A3-Ig4 | WO2009056509 SEQ ID NO: 24 | 3150 |
| MUS169 | NogoA/NiG | Heavy chain variable region | 6A3-IgG1 | WO2009056509 SEQ ID NO: 4 | 3151 |
| MUS170 | RGM A | Heavy chain variable region | 5F9.1-GL | US20150183871 SEQ ID NO: 35 | 3152 |
| MUS171 | RGM A | Heavy chain variable region | 5F9.2-GL | US20150183871 SEQ ID NO: 36 | 3153 |
| MUS172 | RGM A | Heavy chain variable region | 5F9.3-GL | US20150183871 SEQ ID NO: 37 | 3154 |
| MUS173 | RGM A | Heavy chain variable region | 5F9.4-GL | US20150183871 SEQ ID NO: 38 | 3155 |

TABLE 6-continued

Muscle Disease Antibodies

| Antibody No. | Target | Description | Antibody Name | Reference Information | SEQ ID NO |
|---|---|---|---|---|---|
| MUS174 | RGM A | Heavy chain variable region | 5F9.5-GL | US20150183871 SEQ ID NO: 39 | 3156 |
| MUS175 | RGM A | Heavy chain variable region | 5F9.6-GL | US20150183871 SEQ ID NO: 40 | 3157 |
| MUS176 | RGM A | Heavy chain variable region | 5F9.7-GL | US20150183871 SEQ ID NO: 41 | 3158 |
| MUS177 | RGM A | Heavy chain variable region | 5F9.8-GL | US20150183871 SEQ ID NO: 42 | 3159 |
| MUS178 | RGM A | Heavy chain variable region | 5F9.9-GL | US20150183871 SEQ ID NO: 43 | 3160 |
| MUS179 | RGM A | Heavy chain variable region | h5F9.1, h5F9.1, h5F9.1, h5F9.1, h5F9.1, h5F9.2, h5F9.3 | US20150183871 SEQ ID NO: 47 | 3161 |
| MUS180 | RGM A | Heavy chain variable region | h5F9.3, h5F9.9, h5F9.25 | US20150183871 SEQ ID NO: 53 | 3162 |
| MUS181 | RGM A | Heavy chain variable region | h5F9.4, h5F9.10, h5F9.26 | US20150183871 SEQ ID NO: 54 | 3163 |
| MUS182 | RGMa | Heavy chain variable region | AE12-1 | US20140023659 SEQ ID NO: 1 | 3164 |
| MUS183 | RGMa | Heavy chain variable region | AE12-20 | US20140023659 SEQ ID NO: 107 | 3165 |
| MUS184 | RGMa | Heavy chain variable region | AE12-21 | US20140023659 SEQ ID NO: 115 | 3166 |
| MUS185 | RGMa | Heavy chain variable region | AE12-23 | US20140023659 SEQ ID NO: 123 | 3167 |
| MUS186 | RGMa | Heavy chain variable region | AE12-24 | US20140023659 SEQ ID NO: 131 | 3168 |
| MUS187 | RGMa | Heavy chain variable region | AE12-3 | US20140023659 SEQ ID NO: 17 | 3169 |
| MUS188 | RGMa | Heavy chain variable region | AE12-4 | US20140023659 SEQ ID NO: 25 | 3170 |
| MUS189 | RGMa | Heavy chain variable region | AE12-5 | US20140023659 SEQ ID NO: 33 | 3171 |
| MUS190 | RGMa | Heavy chain variable region | AE12-6 | US20140023659 SEQ ID NO: 41 | 3172 |
| MUS191 | RGMa | Heavy chain variable region | AE12-7 | US20140023659 SEQ ID NO: 49 | 3173 |
| MUS192 | RGMa | Heavy chain variable region | AE12-8 | US20140023659 SEQ ID NO: 57 | 3174 |
| MUS193 | RGMa | Heavy chain variable region | AE12-2 | US20140023659 SEQ ID NO: 9 | 3175 |
| MUS194 | RGMa | Heavy chain variable region | AE12-13 | US20140023659 SEQ ID NO: 91 | 3176 |
| MUS195 | RGMa | Heavy chain variable region | AE12-15 | US20140023659 SEQ ID NO: 99 | 3177 |
| MUS196 | S1P4 | Heavy chain variable region | | WO2015057939 SEQ ID NO: 7 | 4323 |
| MUS197 | SOD1 | Heavy chain variable region | NI205.19G5 | US20140301945 SEQ ID NO: 12 | 4324 |
| MUS198 | SOD1 | Heavy chain variable region | | US20140301945 SEQ ID NO: 16 | 4325 |
| MUS199 | SOD1 | Heavy chain variable region | | US20140301945 SEQ ID NO: 20 | 4326 |
| MUS200 | SOD1 | Heavy chain variable region | | US20140301945 SEQ ID NO: 24 | 4327 |
| MUS201 | SOD1 | Heavy chain variable region | Landogrozumab, LY2495655, LY-2495655 | US20140301945 SEQ ID NO: 28 | 4328 |
| MUS202 | SOD1 | Heavy chain variable region | 2A10 construct | US20140301945 SEQ ID NO: 32 | 4329 |
| MUS203 | SOD1 | Heavy chain variable region | 2A10 construct | US20140301945 SEQ ID NO: 36 | 4330 |
| MUS204 | SOD1 | Heavy chain variable region | NI205.1A9 | US20140301945 SEQ ID NO: 4 | 4331 |
| MUS205 | SOD1 | Heavy chain variable region | 2A10 construct | US20140301945 SEQ ID NO: 40 | 4332 |
| MUS206 | SOD1 | Heavy chain variable region | 2A10 construct | US20140301945 SEQ ID NO: 44 | 4333 |
| MUS207 | SOD1 | Heavy chain variable region | 2A10 construct | US20140301945 SEQ ID NO: 48 | 4334 |
| MUS208 | SOD1 | Heavy chain variable region | NI205.14W3 | US20140301945 SEQ ID NO: 8 | 4335 |
| MUS209 | SOD1 | Heavy chain variable region | NI-205.87E7 | U.S. Pat. No. 9,109,037 SEQ ID NO: 1 | 4336 |

TABLE 6-continued

Muscle Disease Antibodies

| Antibody No. | Target | Description | Antibody Name | Reference Information | SEQ ID NO |
|---|---|---|---|---|---|
| MUS210 | SOD1 | Heavy chain variable region | NI205.9E12 | U.S. Pat. No. 9,109,037 SEQ ID NO: 107 | 4337 |
| MUS211 | SOD1 | Heavy chain variable region | NI205.9E12 | U.S. Pat. No. 9,109,037 SEQ ID NO: 113 | 4338 |
| MUS212 | SOD1 | Heavy chain variable region | NI205.98H6 | U.S. Pat. No. 9,109,037 SEQ ID NO: 129 | 4339 |
| MUS213 | SOD1 | Heavy chain variable region | NI205.98H6 | U.S. Pat. No. 9,109,037 SEQ ID NO: 131 | 4340 |
| MUS214 | SOD1 | Heavy chain variable region | NI205.10D3 | U.S. Pat. No. 9,109,037 SEQ ID NO: 147 | 4341 |
| MUS215 | SOD1 | Heavy chain variable region | NI205.10D3 | U.S. Pat. No. 9,109,037 SEQ ID NO: 149 | 4342 |
| MUS216 | SOD1 | Heavy chain variable region | NI205.44B22 | U.S. Pat. No. 9,109,037 SEQ ID NO: 165 | 4343 |
| MUS217 | SOD1 | Heavy chain variable region | NI205.44B22 | U.S. Pat. No. 9,109,037 SEQ ID NO: 167 | 4344 |
| MUS218 | SOD1 | Heavy chain variable region | NI-205.21G1 | U.S. Pat. No. 9,109,037 SEQ ID NO: 17 | 4345 |
| MUS219 | SOD1 | Heavy chain variable region | NI205.38H2 | U.S. Pat. No. 9,109,037 SEQ ID NO: 183 | 4346 |
| MUS220 | SOD1 | Heavy chain variable region | NI-205.21G1 | U.S. Pat. No. 9,109,037 SEQ ID NO: 19 | 4347 |
| MUS221 | SOD1 | Heavy chain variable region | NI205.38H2 | U.S. Pat. No. 9,109,037 SEQ ID NO: 201 | 4348 |
| MUS222 | SOD1 | Heavy chain variable region | NI205.36D5 | U.S. Pat. No. 9,109,037 SEQ ID NO: 217 | 4349 |
| MUS223 | SOD1 | Heavy chain variable region | NI-205.68G5 | U.S. Pat. No. 9,109,037 SEQ ID NO: 35 | 4350 |
| MUS224 | SOD1 | Heavy chain variable region | NI-205.68G5 | U.S. Pat. No. 9,109,037 SEQ ID NO: 37 | 4351 |
| MUS225 | SOD1 | Heavy chain variable region | NI-205.20A1 | U.S. Pat. No. 9,109,037 SEQ ID NO: 53 | 4352 |
| MUS226 | SOD1 | Heavy chain variable region | NI-205.20A1 | U.S. Pat. No. 9,109,037 SEQ ID NO: 55 | 4353 |
| MUS227 | SOD1 | Heavy chain variable region | NI205.41D1 | U.S. Pat. No. 9,109,037 SEQ ID NO: 71 | 4354 |
| MUS228 | SOD1 | Heavy chain variable region | NI205.41D1 | U.S. Pat. No. 9,109,037 SEQ ID NO: 73 | 4355 |
| MUS229 | SOD1 | Heavy chain variable region | NI205.29E11 | U.S. Pat. No. 9,109,037 SEQ ID NO: 89 | 4356 |
| MUS230 | SOD1 | Heavy chain variable region | NI205.29E11 | U.S. Pat. No. 9,109,037 SEQ ID NO: 91 | 4357 |
| MUS231 | TDP-43 | Heavy chain variable region | 2A10 construct | US20140255304 SEQ ID NO: 1 | 4358 |
| MUS232 | TDP-43 | Heavy chain variable region | 2A10 construct | US20140255304 SEQ ID NO: 10 | 4359 |
| MUS233 | TDP-43 | Heavy chain variable region | 2A10 construct | US20140255304 SEQ ID NO: 130 | 4360 |
| MUS234 | TDP-43 | Heavy chain variable region | 2A10 construct | US20140255304 SEQ ID NO: 138 | 4361 |
| MUS235 | TDP-43 | Heavy chain variable region | 2A10 construct | US20140255304 SEQ ID NO: 146 | 4362 |
| MUS236 | TDP-43 | Heavy chain variable region | 2A10 construct | US20140255304 SEQ ID NO: 151 | 4363 |
| MUS237 | TDP-43 | Heavy chain variable region | 2A10 construct | US20140255304 SEQ ID NO: 159 | 4364 |
| MUS238 | TDP-43 | Heavy chain variable region | 2A10 construct | US20140255304 SEQ ID NO: 167 | 4365 |
| MUS239 | TDP-43 | Heavy chain variable region | 2A10 construct | US20140255304 SEQ ID NO: 175 | 4366 |
| MUS240 | TDP-43 | Heavy chain variable region | 2A10 construct | US20140255304 SEQ ID NO: 18 | 4367 |
| MUS241 | TDP-43 | Heavy chain variable region | H6L13 FL, H19L13 FL, H20L13 FL, H21L13 FL, H25L13 FL | US20140255304 SEQ ID NO: 183 | 4368 |
| MUS242 | TDP-43 | Heavy chain variable region | H16L18 FL, H19L18 FL, H20L18 FL, H21L18 FL, H25L18 FL | US20140255304 SEQ ID NO: 191 | 4369 |
| MUS243 | TDP-43 | Heavy chain variable region | H18L16 FL | US20140255304 SEQ ID NO: 199 | 4370 |
| MUS244 | TDP-43 | Heavy chain variable region | H6L13, H6L16, H6L18, H6L14, H6L15, H6L17, H6L6 | US20140255304 SEQ ID NO: 207 | 4371 |

TABLE 6-continued

Muscle Disease Antibodies

| Antibody No. | Target | Description | Antibody Name | Reference Information | SEQ ID NO |
|---|---|---|---|---|---|
| MUS245 | TDP-43 | Heavy chain variable region | H14L13, H14L16, H14L18, H14L14, H14L15, H14L17, H14L6, H14L11 | US20140255304 SEQ ID NO: 215 | 4372 |
| MUS246 | TDP-43 | Heavy chain variable region | H16L13, H16L16, H16L18, H16L14, H16L15, H16L17, H16L6, H16L11 | US20140255304 SEQ ID NO: 223 | 4373 |
| MUS247 | TDP-43 | Heavy chain variable region | H18L13, H18L16, H18L18, H18L14, H18L15, H18L17, H18L6, H18L11 | US20140255304 SEQ ID NO: 231 | 4374 |
| MUS248 | TDP-43 | Heavy chain variable region | H1L13, H5L13, H6L13, H14L13, H15L13, H16L13, H17L13, H18L13, H19L13, H20L13, H21L13, H22L13, H23L13, H24L13, H25L13, H700L13 | US20140255304 SEQ ID NO: 239 | 4375 |
| MUS249 | TDP-43 | Heavy chain variable region | H1L15, H5L15, H6L15, H14L15, H15L15, H16L15, H17L15, H18L15, H19L15, H20L15, H21L15, H22L15, H23L15, H24L15, H25L15, H700L15 | US20140255304 SEQ ID NO: 247 | 4376 |
| MUS250 | TDP-43 | Heavy chain variable region | H1L17, H5L17, H6L17, H14L17, H15L17, H16L17, H17L17, H18L17, H19L17, H20L17, H21L17, H22L17, H23L17, H24L17, H25L17, H700L17 | US20140255304 SEQ ID NO: 255 | 4377 |
| MUS251 | TDP-43 | Heavy chain variable region | 2A10 construct | US20140255304 SEQ ID NO: 26 | 4378 |
| MUS252 | TDP-43 | Heavy chain variable region | H16L16FL, H16L18 FL | US20140255304 SEQ ID NO: 263 | 4379 |
| MUS253 | TDP-43 | Heavy chain variable region | 2A10 construct | US20140255304 SEQ ID NO: 35 | 4380 |
| MUS254 | TDP-43 | Heavy chain variable region | 2A10 construct | US20140255304 SEQ ID NO: 45 | 4381 |
| MUS255 | TDP-43 | Heavy chain variable region | 2A10 construct | US20140255304 SEQ ID NO: 53 | 4382 |
| MUS256 | TDP-43 | Heavy chain variable region | 2A10 construct | US20140255304 SEQ ID NO: 61 | 4383 |
| MUS257 | TDP-43 | Heavy chain variable region | 2A10 construct | US20140255304 SEQ ID NO: 69 | 4384 |
| MUS258 | TDP-43 | Heavy chain variable region | 2A10 construct | US20140255304 SEQ ID NO: 77 | 4385 |
| MUS259 | TDP-43 | Heavy chain variable region | 2A10 construct | US20140255304 SEQ ID NO: 87 | 4386 |
| MUS260 | trkC | Heavy chain variable region | | US20070031418 SEQ ID NO: 1 | 4387 |
| MUS261 | NOGO | Heavy chain variable region humanized construct H1 | 2A10 construct | WO2007003421 SEQ ID NO: 77 | 3181 |
| MUS262 | NOGO | Heavy chain variable region humanized construct H14 | 2A10 construct | WO2007003421 SEQ ID NO: 14 | 3182 |
| MUS263 | NOGO | Heavy chain variable region humanized construct H15 | 2A10 construct | WO2007003421 SEQ ID NO: 15 | 3183 |
| MUS264 | NOGO | Heavy chain variable region humanized construct H16 | 2A10 construct | WO2007003421 SEQ ID NO: 16 | 3184 |

TABLE 6-continued

Muscle Disease Antibodies

| Antibody No. | Target | Description | Antibody Name | Reference Information | SEQ ID NO |
|---|---|---|---|---|---|
| MUS265 | NOGO | Heavy chain variable region humanized construct H17 | 2A10 construct | WO2007003421 SEQ ID NO: 17 | 3185 |
| MUS266 | NOGO | Heavy chain variable region humanized construct H18 | 2A10 construct | WO2007003421 SEQ ID NO: 18 | 3186 |
| MUS267 | NOGO | Heavy chain variable region humanized construct H19 | 2A10 construct | WO2007003421 SEQ ID NO: 85 | 3187 |
| MUS268 | NOGO | Heavy chain variable region humanized construct H20 | 2A10 construct | WO2007003421 SEQ ID NO: 86 | 3188 |
| MUS269 | NOGO | Heavy chain variable region humanized construct H21 | 2A10 construct | WO2007003421 SEQ ID NO: 87 | 3189 |
| MUS270 | NOGO | Heavy chain variable region humanized construct H22 | 2A10 construct | WO2007003421 SEQ ID NO: 88 | 3190 |
| MUS271 | NOGO | Heavy chain variable region humanized construct H23 | 2A10 construct | WO2007003421 SEQ ID NO: 89 | 3191 |
| MUS272 | NOGO | Heavy chain variable region humanized construct H24 | 2A10 construct | WO2007003421 SEQ ID NO: 90 | 3192 |
| MUS273 | NOGO | Heavy chain variable region humanized construct H25 | 2A10 construct | WO2007003421 SEQ ID NO: 91 | 3193 |
| MUS274 | NOGO | Heavy chain variable region humanized construct H5 | 2A10 construct | WO2007003421 SEQ ID NO: 11 | 3194 |
| MUS275 | NOGO | Heavy chain variable region humanized construct H6 | 2A10 construct | WO2007003421 SEQ ID NO: 12 | 3195 |
| MUS276 | NOGO | Heavy chain variable region construct H700 | 2A10 construct | WO2007003421 SEQ ID NO: 13 | 3196 |
| MUS277 | ACVR2B (SMA - muscle growth) | Light chain | H7L4, H7L5, H7L6 | U.S. Pat. No. 8,388,968 SEQ ID NO: 141 | 4388 |
| MUS278 | ACVR2B | Light chain | | U.S. Pat. No. 8,388,968 SEQ ID NO: 141 | 4389 |
| MUS279 | amyloids | Light chain | #118 | WO2010012004 SEQ ID NO: 10 | 3242 |
| MUS280 | amyloids | Light chain | #121 | WO2010012004 SEQ ID NO: 12 | 3243 |
| MUS281 | amyloids | Light chain | #201 | WO2010012004 SEQ ID NO: 14 | 3244 |
| MUS282 | amyloids | Light chain | #204 | WO2010012004 SEQ ID NO: 15 | 3245 |
| MUS283 | amyloids | Light chain | #205 | WO2010012004 SEQ ID NO: 17 | 3246 |
| MUS284 | EAG1 | Light chain | chimeric ImAb3 | WO2006037604 SEQ ID NO: 10 | 3247 |
| MUS285 | EAG1 | Light chain | chimeric ImAb4 | WO2006037604 SEQ ID NO: 14 | 3248 |
| MUS286 | EAG1 | Light chain | LC-lmAb3-humB3 | WO2006037604 SEQ ID NO: 18 | 3249 |
| MUS287 | EAG1 | Light chain | ImAb4 | WO2006037604 SEQ ID NO: 2 | 3250 |
| MUS288 | EAG1 | Light chain | LC-lmAb4-humA17 | WO2006037604 SEQ ID NO: 22 | 3251 |
| MUS289 | EAG1 | Light chain | LC-lmAb3-humA3 | WO2006037604 SEQ ID NO: 26 | 3252 |

TABLE 6-continued

Muscle Disease Antibodies

| Antibody No. | Target | Description | Antibody Name | Reference Information | SEQ ID NO |
|---|---|---|---|---|---|
| MUS290 | EAG1 | Light chain | LC-lmAb3-humA17 | WO2006037604 SEQ ID NO: 30 | 3253 |
| MUS291 | EAG1 | Light chain | LC-lmAb4-humA5-1 | WO2006037604 SEQ ID NO: 34 | 3254 |
| MUS292 | EAG1 | Light chain | LC-lmAb4-humO1 | WO2006037604 SEQ ID NO: 38 | 3255 |
| MUS293 | EAG1 | Light chain | lmAb3 | WO2006037604 SEQ ID NO: 6 | 3256 |
| MUS294 | GDF-8 | Light chain | 597-120-M1 | US20130287762 SEQ ID NO: 12 | 4390 |
| MUS295 | GDF-8 | Light chain | 597-120 | US20130287762 SEQ ID NO: 18 | 4391 |
| MUS296 | GDF-8 | Light chain | 311-3 | US20130287762 SEQ ID NO: 6 | 4392 |
| MUS297 | growth differentiation factor 8 | Light chain | | | 4393 |
| MUS298 | growth differentiation factor 8 | Light chain | Domagrozumab | | 4394 |
| MUS299 | MAG | Light chain | | | 4395 |
| MUS300 | MSTN | Light chain | H25L13, H25L16, H25L18, H25L14, H25L15, H25L17, H25L6, H25L11 | | 4396 |
| MUS301 | Myostatin | Light chain | 306-155 | US20130142788 SEQ ID NO: 145 | 4397 |
| MUS302 | Myostatin | Light chain | 14-173 | US20130142788 SEQ ID NO: 146 | 4398 |
| MUS303 | Myostatin | Light chain | 14-173-M1 | US20130142788 SEQ ID NO: 147 | 4399 |
| MUS304 | myostatin | Light chain | NI-204.67E12 | US20110256132 SEQ ID NO: 27 | 4400 |
| MUS305 | myostatin | Light chain | NI-204.12G3 | US20110256132 SEQ ID NO: 31 | 4401 |
| MUS306 | myostatin | Light chain | NI-204.12G3 | US20110256132 SEQ ID NO: 32 | 4402 |
| MUS307 | myostatin | Light chain | NI-204.7G5 | US20110256132 SEQ ID NO: 33 | 4403 |
| MUS308 | myostatin | Light chain | NI-204.7G5 | US20110256132 SEQ ID NO: 34 | 4404 |
| MUS309 | Myostatin | Light chain | 114-41-M1 | US20130142788 SEQ ID NO: 27 | 4405 |
| MUS310 | Myostatin | Light chain | 14-173, 14-173-M1 | US20130142788 SEQ ID NO: 33 | 4406 |
| MUS311 | Myostatin | Light chain | 306-155 | US20130142788 SEQ ID NO: 37 | 4407 |
| MUS312 | Myostatin | Light chain | 303-8 | US20130142788 SEQ ID NO: 40 | 4408 |
| MUS313 | myostatin antagonists | Light chain | NI-204.34A3 | US20130209489 SEQ ID NO: 1 | 4409 |
| MUS314 | myostatin antagonists | Light chain | NI-205.21G2 | US20130209489 SEQ ID NO: 10 | 4410 |
| MUS315 | myostatin antagonists | Light chain | NI-204.25H3 | US20130209489 SEQ ID NO: 2 | 4411 |
| MUS316 | myostatin antagonists | Light chain | NI-204.25H3 | US20130209489 SEQ ID NO: 3 | 4412 |
| MUS317 | myostatin antagonists | Light chain | B12 | US20130209489 SEQ ID NO: 4 | 4413 |
| MUS318 | myostatin antagonists | Light chain | B1 | US20130209489 SEQ ID NO: 5 | 4414 |
| MUS319 | myostatin antagonists | Light chain | NI-205.3F10 | US20130209489 SEQ ID NO: 6 | 4415 |
| MUS320 | myostatin antagonists | Light chain | NI-205.3F10 | US20130209489 SEQ ID NO: 7 | 4416 |
| MUS321 | myostatin antagonists | Light chain | NI-205.51C1 | US20130209489 SEQ ID NO: 8 | 4417 |
| MUS322 | myostatin antagonists | Light chain | NI-205.51C1 | US20130209489 SEQ ID NO: 9 | 4418 |
| MUS323 | NOGO | Light chain | H6L13 FL, H19L13 FL, H20L13 FL, H21L13 FL, H25L13 FL | US20140147435 SEQ ID NO: 35 | 3257 |
| MUS324 | NOGO | Light chain | H16L16 FL, H19L16 FL, H20L16 FL, | US20140147435 SEQ ID NO: 38 | 3258 |

TABLE 6-continued

Muscle Disease Antibodies

| Antibody No. | Target | Description | Antibody Name | Reference Information | SEQ ID NO |
|---|---|---|---|---|---|
| MUS325 | NOGO | Light chain | H21L16 FL, H25L16 FL, H18L16 FL H16L18 FL, H19L18 FL, H20L18 FL, H21L18 FL, H25L18 FL | US20140147435 SEQ ID NO: 40 | 3259 |
| MUS326 | Nogo receptor-1 | Light chain | 7E11 | US20090215691 SEQ ID NO: 15 | 3260 |
| MUS327 | Nogo receptor-1 | Light chain | 7E11 | US20090215691 SEQ ID NO: 17 | 3261 |
| MUS328 | RTN4 | Light chain | | | 4419 |
| MUS329 | S1P4 | Light chain | | WO2015057939 SEQ ID NO: 41 | 4420 |
| MUS330 | trk-C (NT-3 trkC ligand) | Light chain | 2250 | U.S. Pat. No. 7,615,383 SEQ ID NO: 49 | 3262 |
| MUS331 | trk-C (NT-3 trkC ligand) | Light chain | 2253 | U.S. Pat. No. 7,615,383 SEQ ID NO: 50 | 3263 |
| MUS332 | trk-C (NT-3 trkC ligand) | Light chain | 2256 | U.S. Pat. No. 7,615,383 SEQ ID NO: 51 | 3264 |
| MUS333 | trk-C (NT-3 trkC ligand) | Light chain | 6.1.2 | U.S. Pat. No. 7,615,383 SEQ ID NO: 52 | 3265 |
| MUS334 | trk-C (NT-3 trkC ligand) | Light chain | 6.4.1 | U.S. Pat. No. 7,615,383 SEQ ID NO: 53 | 3266 |
| MUS335 | trk-C (NT-3 trkC ligand) | Light chain | 2345 | U.S. Pat. No. 7,615,383 SEQ ID NO: 54 | 3267 |
| MUS336 | trk-C (NT-3 trkC ligand) | Light chain | 2349 | U.S. Pat. No. 7,615,383 SEQ ID NO: 55 | 3268 |
| MUS337 | GDF-8 | Light chain constant region | 12A5-18HC | U.S. Pat. No. 8,956,608 SEQ ID NO: 17 | 4421 |
| MUS338 | many - growth factors (to increase transport across BBB) | Light chain fusion protein | H21L13, H21L16, H21L18, H21L14, H21L15, H21L17, H21L6, H21L11 | U.S. Pat. No. 8,053,569 SEQ ID NO: 31 | 3275 |
| MUS339 | many - growth factors (to increase transport across BBB) | Light chain fusion protein | H23L13, H23L16, H23L18, H23L14, H23L15, H23L17, H23L6, H23L11 | U.S. Pat. No. 8,053,569 SEQ ID NO: 36 | 3276 |
| MUS340 | NOGO | Light chain construct L11 | 2A10 construct | WO2007003421 SEQ ID NO: 80 | 3277 |
| MUS341 | NOGO | Light chain humanized construct L13 | 2A10 construct | WO2007003421 SEQ ID NO: 35 | 3278 |
| MUS342 | NOGO | Light chain humanized construct L14 | 2A10 construct | WO2007003421 SEQ ID NO: 36 | 3279 |
| MUS343 | NOGO | Light chain humanized construct L15 | 2A10 construct | WO2007003421 SEQ ID NO: 37 | 3280 |
| MUS344 | NOGO | Light chain humanized construct L16 | 2A10 construct | WO2007003421 SEQ ID NO: 38 | 3281 |
| MUS345 | NOGO | Light chain humanized construct L17 | 2A10 construct | WO2007003421 SEQ ID NO: 39 | 3282 |
| MUS346 | NOGO | Light chain humanized construct L18 | 2A10 construct | WO2007003421 SEQ ID NO: 40 | 3283 |
| MUS347 | NOGO | Light chain construct L6 | 2A10 construct | WO2007003421 SEQ ID NO: 34 | 3284 |
| MUS348 | RTN4 | Light chain IgG4, immunomodulator | Atinumab | U.S. Pat. No. 8,163,285 SEQ ID NO: 25 | 3285 |
| MUS349 | amyloid oligomers | Light chain variable region | F11G3 | U.S. Pat. No. 9,125,846 SEQ ID NO: 12 | 3315 |
| MUS350 | differentiation factor 8 (GDF8) | Light chain variable region | H9L4, H9L5, H8L6 | US20140023638 SEQ ID NO: 18 | 4422 |
| MUS351 | DR6 and P75 | Light chain variable region | M73-C04 | WO2010062904 SEQ ID NO: 102 | 3316 |
| MUS352 | DR6 and P75 | Light chain variable region | 1P1D6.3 | WO2010062904 SEQ ID NO: 112 | 3317 |
| MUS353 | DR6 and P75 | Light chain variable region | M50-H02 | WO2010062904 SEQ ID NO: 12 | 3318 |
| MUS354 | DR6 and P75 | Light chain variable region | 1P2F2.1 | WO2010062904 SEQ ID NO: 122 | 3319 |

TABLE 6-continued

Muscle Disease Antibodies

| Antibody No. | Target | Description | Antibody Name | Reference Information | SEQ ID NO |
|---|---|---|---|---|---|
| MUS355 | DR6 and P75 | Light chain variable region | 1P5D10.2 | WO2010062904 SEQ ID NO: 132 | 3320 |
| MUS356 | DR6 and P75 | Light chain variable region | M5L-H09 | WO2010062904 SEQ ID NO: 22 | 3321 |
| MUS357 | DR6 and P75 | Light chain variable region | M53-E04 | WO2010062904 SEQ ID NO: 32 | 3322 |
| MUS358 | DR6 and P75 | Light chain variable region | M53-F04 | WO2010062904 SEQ ID NO: 42 | 3323 |
| MUS359 | DR6 and P75 | Light chain variable region | M62-B02 | WO2010062904 SEQ ID NO: 52 | 3324 |
| MUS360 | DR6 and P75 | Light chain variable region | M63-E10 | WO2010062904 SEQ ID NO: 62 | 3325 |
| MUS361 | DR6 and P75 | Light chain variable region | M66-B03 | WO2010062904 SEQ ID NO: 72 | 3326 |
| MUS362 | DR6 and P75 | Light chain variable region | M67-G02 | WO2010062904 SEQ ID NO: 82 | 3327 |
| MUS363 | DR6 and P75 | Light chain variable region | M72-F03 | WO2010062904 SEQ ID NO: 92 | 3328 |
| MUS364 | GDF-8 | Light chain variable region | 595-16-M1 | U.S. Pat. No. 8,956,608 SEQ ID NO: 27 | 4423 |
| MUS365 | GDF-8 | Light chain variable region | A12A5-12HC | U.S. Pat. No. 8,956,608 SEQ ID NO: 9 | 4424 |
| MUS366 | growth differentiation factor 8 | Light chain variable region | | U.S. Pat. No. 8,840,894 SEQ ID NO: 368 | 4425 |
| MUS367 | LPG (lyso-phosphatidyl-glucoside) | Light chain variable region | #7 | U.S. Pat. No. 8,591,902 SEQ ID NO: 17 | 3329 |
| MUS368 | LPG (lyso-phosphatidyl-glucoside) | Light chain variable region | #15 | U.S. Pat. No. 8,591,902 SEQ ID NO: 7 | 3330 |
| MUS369 | MAG | Light chain variable region | | U.S. Pat. No. 8,071,731 SEQ ID NO: 16 | 3331 |
| MUS370 | MAG | Light chain variable region | | U.S. Pat. No. 8,071,731 SEQ ID NO: 17 | 3332 |
| MUS371 | MAG | Light chain variable region | | U.S. Pat. No. 8,071,731 SEQ ID NO: 18 | 3333 |
| MUS372 | MAG | Light chain variable region | | U.S. Pat. No. 8,071,731 SEQ ID NO: 19 | 3334 |
| MUS373 | MAI (myelin associated inhibitor) | Light chain variable region | | WO2013158748 SEQ ID NO: 11 | 3335 |
| MUS374 | MAI (myelin associated inhibitor) | Light chain variable region | | WO2013158748 SEQ ID NO: 27 | 3336 |
| MUS375 | myostatin | Light chain variable region | NI-204.34A3 | SEQ ID 8 WO 2006107611 | 4426 |
| MUS376 | myostatin | Light chain variable region | NI-204.9F6 | US20110256132 SEQ ID NO: 17 | 4427 |
| MUS377 | myostatin | Light chain variable region | NT-204.9F6 | US20110256132 SEQ ID NO: 21 | 4428 |
| MUS378 | myostatin | Light chain variable region | NI-204.11F11 | US20110256132 SEQ ID NO: 24 | 4429 |
| MUS379 | myostatin | Light chain variable region | 303-8 | US20110256132 SEQ ID NO: 7 | 4430 |
| MUS380 | NOGO | Light chain variable region | H1L6, H5L6, H6L6, H14L6, H15L6, H16L6, H17L6, H18L6, H19L6, H20L6, H21L6, H22L6, H23L6, H24L6, H25L6, H700L6 | US20140147435 SEQ ID NO: 19 | 3338 |
| MUS381 | NOGO | Light chain variable region | H1L13, H5L13, H6L13, H14L13, H15L13, H16L13, H17L13, H18L13, H19L13, H20L13, H21L13, H22L13, H23L13, H24L13, H25L13, H700L13 | US20140147435 SEQ ID NO: 20 | 3339 |
| MUS382 | NOGO | Light chain variable region | H1L14, H5L14, H6L14, H14L14, H15L14, H16L14, H17L14, H18L14, | US20140147435 SEQ ID NO: 21 | 3340 |

TABLE 6-continued

Muscle Disease Antibodies

| Antibody No. | Target | Description | Antibody Name | Reference Information | SEQ ID NO |
|---|---|---|---|---|---|
| MUS383 | NOGO | Light chain variable region | H19L14, H20L14, H21L14, H22L14, H23L14, H24L14, H25L14, H700L14 H1L15, H5L15, H6L15, H14L15, H15L15, H16L15, H17L15, H18L15, H19L15, H20L15, H21L15, H22L15, H23L15, H24L15, H25L15, H700L15 | US20140147435 SEQ ID NO: 22 | 3341 |
| MUS384 | NOGO | Light chain variable region | H1L16, H5L16, H6L16, H14L16, H15L16, H16L16, H17L16, H18L16, H19L16, H20L16, H21L16, H22L16, H23L16, H24L16, H25L16, H700L16 | US20140147435 SEQ ID NO: 23 | 3342 |
| MUS385 | NOGO | Light chain variable region | H1L17, H5L17, H6L17, H14L17, H15L17, H16L17, H17L17, H18L17, H19L17, H20L17, H21L17, H22L17, H23L17, H24L17, H25L17, H700L17 | US20140147435 SEQ ID NO: 24 | 3343 |
| MUS386 | NOGO | Light chain variable region | H1L18, H5L18, H6L18, H14L18, H15L18, H16L18, H17L18, H18L18, H19L18, H20L18, H21L18, H22L18, H23L18, H24L18, H25L18, H700L18 | US20140147435 SEQ ID NO: 25 | 3344 |
| MUS387 | NOGO | Light chain variable region | H5L11, H6L11, H14L11, H15L11, H16L11, H17L11, H18L11, H19L11, H20L11, H21L11, H22L11, H23L11, H24L11, H25L11, H700L11 | US20140147435 SEQ ID NO: 78 | 3345 |
| MUS388 | Nogo-66 | Light chain variable region | Antibody clone 50 | US20140065155 SEQ ID NO: 4 | 3346 |
| MUS389 | Nogo-66 | Light chain variable region | Antibody clone 51 | US20140065155 SEQ ID NO: 6 | 3347 |
| MUS390 | NogoA/NiG | Light chain variable region | 6A3-Ig4 | WO2009056509 SEQ ID NO: 25 | 3348 |
| MUS391 | NogoA/NiG | Light chain variable region | 6A3-IgG1 | WO2009056509 SEQ ID NO: 5 | 3349 |
| MUS392 | RGM A | Light chain variable region | 5F9.1-GL, 5F9.1-GL, 5F9.1-GL, 5F9.1-GL, 5F9.1-GL, 5F9.1-GL, 5F9.1-GL, 5F9.1-GL, h5F9.4, h5F9.11, h5F9.12 | US20150183871 SEQ ID NO: 44 | 3350 |
| MUS393 | RGM A | Light chain variable region | 5F9.2-GL, 5F9.2-GL, 5F9.2-GL, 5F9.2-GL, 5F9.2-GL, 5F9.2-GL, 5F9.2-GL, 5F9.2-GL, h5F9.5, h5F9.19, h5F9.20 | US20150183871 SEQ ID NO: 45 | 3351 |
| MUS394 | RGM A | Light chain variable region | 5F9.3-GL, 5F9.3-GL, 5F9.3-GL, 5F9.3-GL, 5F9.3-GL, 5F9.3-GL, 5F9.3-GL, 5F9.3-GL, h5F9.6, h5F9.21, h5F9.22 | US20150183871 SEQ ID NO: 46 | 3352 |

TABLE 6-continued

Muscle Disease Antibodies

| Antibody No. | Target | Description | Antibody Name | Reference Information | SEQ ID NO |
|---|---|---|---|---|---|
| MUS395 | RGM A | Light chain variable region | h5F9.5, h5F9.6, h5F9.7, h5F9.8, h5F9.9, h5F9.10 | US20150183871 SEQ ID NO: 48 | 3353 |
| MUS396 | RGM A | Light chain variable region | h5F9.11, h5F9.19, h5F9.21 | US20150183871 SEQ ID NO: 49 | 3354 |
| MUS397 | RGM A | Light chain variable region | h5F9.12, h5F9.20, h5F9.22, h5F9.23, h5F9.25, h5F9.25, h5F9.26 | US20150183871 SEQ ID NO: 50 | 3355 |
| MUS398 | RGM A | Light chain variable region | h5F9.1, h5F9.7, h5F9.23 | US20150183871 SEQ ID NO: 51 | 3356 |
| MUS399 | RGM A | Light chain variable region | h5F9.2, h5F9.8, h5F9.25 | US20150183871 SEQ ID NO: 52 | 3357 |
| MUS400 | RGMa | Light chain variable region | AE12-15 | US20140023659 SEQ ID NO: 103 | 3358 |
| MUS401 | RGMa | Light chain variable region | AE12-20 | US20140023659 SEQ ID NO: 111 | 3359 |
| MUS402 | RGMa | Light chain variable region | AE12-21 | US20140023659 SEQ ID NO: 119 | 3360 |
| MUS403 | RGMa | Light chain variable region | AE12-23 | US20140023659 SEQ ID NO: 127 | 3361 |
| MUS404 | RGMa | Light chain variable region | AE12-2 | US20140023659 SEQ ID NO: 13 | 3362 |
| MUS405 | RGMa | Light chain variable region | AE12-24 | US20140023659 SEQ ID NO: 135 | 3363 |
| MUS406 | RGMa | Light chain variable region | AE12-3 | US20140023659 SEQ ID NO: 21 | 3364 |
| MUS407 | RGMa | Light chain variable region | AE12-4 | US20140023659 SEQ ID NO: 29 | 3365 |
| MUS408 | RGMa | Light chain variable region | AE12-5 | US20140023659 SEQ ID NO: 37 | 3366 |
| MUS409 | RGMa | Light chain variable region | AE12-6 | US20140023659 SEQ ID NO: 45 | 3367 |
| MUS410 | RGMa | Light chain variable region | AE12-1 | US20140023659 SEQ ID NO: 5 | 3368 |
| MUS411 | RGMa | Light chain variable region | AE12-7 | US20140023659 SEQ ID NO: 53 | 3369 |
| MUS412 | RGMa | Light chain variable region | AE12-8 | US20140023659 SEQ ID NO: 61 | 3370 |
| MUS413 | RGMa | Light chain variable region | AE12-13 | US20140023659 SEQ ID NO: 95 | 3371 |
| MUS414 | S1P4 | Light chain variable region | | WO2015057939 SEQ ID NO: 9 | 4431 |
| MUS415 | SOD1 | Light chain variable region | NI205.14W3 | US20140301945 SEQ ID NO: 10 | 4432 |
| MUS416 | SOD1 | Light chain variable region | NI205.19G5 | US20140301945 SEQ ID NO: 14 | 4433 |
| MUS417 | SOD1 | Light chain variable region | | US20140301945 SEQ ID NO: 18 | 4434 |
| MUS418 | SOD1 | Light chain variable region | | US20140301945 SEQ ID NO: 22 | 4435 |
| MUS419 | SOD1 | Light chain variable region | | US20140301945 SEQ ID NO: 26 | 4436 |
| MUS420 | SOD1 | Light chain variable region | Landogrozumab, LY2495655, LY-2495656 | US20140301945 SEQ ID NO: 30 | 4437 |
| MUS421 | SOD1 | Light chain variable region | 2A10 construct | US20140301945 SEQ ID NO: 34 | 4438 |
| MUS422 | SOD1 | Light chain variable region | 2A10 construct | US20140301945 SEQ ID NO: 38 | 4439 |
| MUS423 | SOD1 | Light chain variable region | 2A10 construct | US20140301945 SEQ ID NO: 42 | 4440 |
| MUS424 | SOD1 | Light chain variable region | 2A10 construct | US20140301945 SEQ ID NO: 46 | 4441 |
| MUS425 | SOD1 | Light chain variable region | 2A10 construct | US20140301945 SEQ ID NO: 50 | 4442 |
| MUS426 | SOD1 | Light chain variable region | NI205.1A9 | US20140301945 SEQ ID NO: 6 | 4443 |
| MUS427 | SOD1 | Light chain variable region | NI205.31D2 | U.S. Pat. No. 9,109,037 SEQ ID NO: 109 | 4444 |
| MUS428 | SOD1 | Light chain variable region | NI205.8F8 | U.S. Pat. No. 9,109,037 SEQ ID NO: 121 | 4445 |
| MUS429 | SOD1 | Light chain variable region | NI205.8F8 | U.S. Pat. No. 9,109,037 SEQ ID NO: 139 | 4446 |

TABLE 6-continued

Muscle Disease Antibodies

| Antibody No. | Target | Description | Antibody Name | Reference Information | SEQ ID NO |
|---|---|---|---|---|---|
| MUS430 | SOD1 | Light chain variable region | NI205.31C11 | U.S. Pat. No. 9,109,037 SEQ ID NO: 157 | 4447 |
| MUS431 | SOD1 | Light chain variable region | NI205.31C11 | U.S. Pat. No. 9,109,037 SEQ ID NO: 175 | 4448 |
| MUS432 | SOD1 | Light chain variable region | NI205.8C10 | U.S. Pat. No. 9,109,037 SEQ ID NO: 191 | 4449 |
| MUS433 | SOD1 | Light chain variable region | NI205.8C10 | U.S. Pat. No. 9,109,037 SEQ ID NO: 199 | 4450 |
| MUS434 | SOD1 | Light chain variable region | NI205.10H7 | U.S. Pat. No. 9,109,037 SEQ ID NO: 209 | 4451 |
| MUS435 | SOD1 | Light chain variable region | NI205.10H7 | U.S. Pat. No. 9,109,037 SEQ ID NO: 225 | 4452 |
| MUS436 | SOD1 | Light chain variable region | NI205.58E11 | U.S. Pat. No. 9,109,037 SEQ ID NO: 27 | 4453 |
| MUS437 | SOD1 | Light chain variable region | N1205.58E11 | U.S. Pat. No. 9,109,037 SEQ ID NO: 45 | 4454 |
| MUS438 | SOD1 | Light chain variable region | NI205.14H5 | U.S. Pat. No. 9,109,037 SEQ ID NO: 63 | 4455 |
| MUS439 | SOD1 | Light chain variable region | NI205.14H5 | U.S. Pat. No. 9,109,037 SEQ ID NO: 81 | 4456 |
| MUS440 | SOD1 | Light chain variable region | NI205.36D5 | U.S. Pat. No. 9,109,037 SEQ ID NO: 9 | 4457 |
| MUS441 | SOD1 | Light chain variable region | NI205.31D2 | U.S. Pat. No. 9,109,037 SEQ ID NO: 99 | 4458 |
| MUS442 | TDP-43 | Light chain variable region | 2A10 construct | US20140255304 SEQ ID NO: 122 | 4459 |
| MUS443 | TDP-43 | Light chain variable region | 2A10 construct | US20140255304 SEQ ID NO: 134 | 4460 |
| MUS444 | TDP-43 | Light chain variable region | 2A10 construct | US20140255304 SEQ ID NO: 14 | 4461 |
| MUS445 | TDP-43 | Light chain variable region | 2A10 construct | US20140255304 SEQ ID NO: 142 | 4462 |
| MUS446 | TDP-43 | Light chain variable region | 2A10 construct | US20140255304 SEQ ID NO: 150 | 4463 |
| MUS447 | TDP-43 | Light chain variable region | 2A10 construct | US20140255304 SEQ ID NO: 155 | 4464 |
| MUS448 | TDP-43 | Light chain variable region | 2A10 construct | US20140255304 SEQ ID NO: 163 | 4465 |
| MUS449 | TDP-43 | Light chain variable region | 2A10 construct | US20140255304 SEQ ID NO: 171 | 4466 |
| MUS450 | TDP-43 | Light chain variable region | 2A10 construct | US20140255304 SEQ ID NO: 179 | 4467 |
| MUS451 | TDP-43 | Light chain variable region | H16L16 FL, H19L16 FL, H20L16 FL, H21L16 FL, H25L16 FL, H18L16 FL | US20140255304 SEQ ID NO: 187 | 4468 |
| MUS452 | TDP-43 | Light chain variable region | H6L13 FL | US20140255304 SEQ ID NO: 195 | 4469 |
| MUS453 | TDP-43 | Light chain variable region | H5L13, H5L16, H5L18, H5L14, H5L15, H5L17, H5L6, H5L11 | US20140255304 SEQ ID NO: 203 | 4470 |
| MUS454 | TDP-43 | Light chain variable region | H700L13, H700L16, H700L18, H700L14, H700L15, H700L17, H700L6, H700L11 | US20140255304 SEQ ID NO: 211 | 4471 |
| MUS455 | TDP-43 | Light chain variable region | H15L13, H15L16, H15L18, H15L14, H15L15, H15L17, H15L6, H15L11 | US20140255304 SEQ ID NO: 219 | 4472 |
| MUS456 | TDP-43 | Light chain variable region | 2A10 construct | US20140255304 SEQ ID NO: 22 | 4473 |
| MUS457 | TDP-43 | Light chain variable region | H17L13, H17L16, H17L18, H17L14, H17L15, H17L17, H17L6, H17L11 | US20140255304 SEQ ID NO: 227 | 4474 |
| MUS458 | TDP-43 | Light chain variable region | H1L6, H5L6, H6L6, H14L6, H15L6, H16L6, H17L6, H18L6, H19L6, H20L6, H21L6, H22L6, H23L6, H24L6, H25L6, H700L6 | US20140255304 SEQ ID NO: 235 | 4475 |

TABLE 6-continued

Muscle Disease Antibodies

| Antibody No. | Target | Description | Antibody Name | Reference Information | SEQ ID NO |
|---|---|---|---|---|---|
| MUS459 | TDP-43 | Light chain variable region | H1L14, H5L14, H6L14, H14L14, H15L14, H16L14, H17L14, H18L14, H19L14, H20L14, H21L14, H22L14, H23L14, H24L14, H25L14, H700L14 | US20140255304 SEQ ID NO: 243 | 4476 |
| MUS460 | TDP-43 | Light chain variable region | H1L16, H5L16, H6L16, H14L16, H15L16, H16L16, H17L16, H18L16, H19L16, H20L16, H21L16, H22L16, H23L16, H24L16, H25L16, H700L16 | US20140255304 SEQ ID NO: 251 | 4477 |
| MUS461 | TDP-43 | Light chain variable region | H1L18, H5L18, H6L18, H14L18, H15L18, H16L18, H17L18, H18L18, H19L18, H20L18, H21L18, H22L18, H23L18, H24L18, H25L18, H700L18 | US20140255304 SEQ ID NO: 259 | 4478 |
| MUS462 | TDP-43 | Light chain variable region | H1L13, H1L16, H1L18, H1L14, H1L15, H1L17, H1L6 | US20140255304 SEQ ID NO: 267 | 4479 |
| MUS463 | TDP-43 | Light chain variable region | 2A10 construct | US20140255304 SEQ ID NO: 31 | 4480 |
| MUS464 | TDP-43 | Light chain variable region | 2A10 construct | US20140255304 SEQ ID NO: 40 | 4481 |
| MUS465 | TDP-43 | Light chain variable region | 2A10 construct | US20140255304 SEQ ID NO: 49 | 4482 |
| MUS466 | TDP-43 | Light chain variable region | 2A10 construct | US20140255304 SEQ ID NO: 57 | 4483 |
| MUS467 | TDP-43 | Light chain variable region | 2A10 construct | US20140255304 SEQ ID NO: 6 | 4484 |
| MUS468 | TDP-43 | Light chain variable region | 2A10 construct | US20140255304 SEQ ID NO: 65 | 4485 |
| MUS469 | TDP-43 | Light chain variable region | 2A10 construct | US20140255304 SEQ ID NO: 73 | 4486 |
| MUS470 | TDP-43 | Light chain variable region | 2A10 construct | US20140255304 SEQ ID NO: 82 | 4487 |
| MUS471 | trkC | Light chain variable region | | US20070031418 SEQ ID NO: 2 | 4488 |
| MUS472 | NOGO | Light chain variable region humanized construct L11 | 2A10 construct | WO2007003421 SEQ ID NO: 78 | 3375 |
| MUS473 | NOGO | Light chain variable region humanized construct L13 | 2A10 construct | WO2007003421 SEQ ID NO: 20 | 3376 |
| MUS474 | NOGO | Light chain variable region humanized construct L14 | 2A10 construct | WO2007003421 SEQ ID NO: 21 | 3377 |
| MUS475 | NOGO | Light chain variable region humanized construct L15 | 2A10 construct | WO2007003421 SEQ ID NO: 22 | 3378 |
| MUS476 | NOGO | Light chain variable region humanized construct L16 | 2A10 construct | WO2007003421 SEQ ID NO: 23 | 3379 |
| MUS477 | NOGO | Light chain variable region humanized construct L17 | 2A10 construct | WO2007003421 SEQ ID NO: 24 | 3380 |
| MUS478 | NOGO | Light chain variable region humanized construct L18 | 2A10 construct | WO2007003421 SEQ ID NO: 25 | 3381 |

TABLE 6-continued

Muscle Disease Antibodies

| Antibody No. | Target | Description | Antibody Name | Reference Information | SEQ ID NO |
|---|---|---|---|---|---|
| MUS479 | NOGO | Light chain variable region humanized construct L6 | 2A10 construct | WO2007003421 SEQ ID NO: 19 | 3382 |
| MUS480 | GDF-8 | scFv | 591-37 | US20130287762 SEQ ID NO: 14 | 4489 |
| MUS481 | GDF-8 | scFv | 358-11 | US20130287762 SEQ ID NO: 2 | 4490 |
| MUS482 | GDF-8 | scFv | 591-37-M1 | US20130287762 SEQ ID NO: 8 | 4491 |
| MUS483 | myostatin | scFv | NI-204.7B3 | SEQ ID 4 WO 2006107611 | 4492 |
| MUS484 | SOD1 | scFv | 2A10 construct | Ghadge, G. D. et al., Single chain variable fragment antibodies block aggregation and toxicity induced by familial ALS-linked mutant forms of SOD1, Neurobiol. Dis. (2013), NCBI Accession # AGK37119.1 | 4493 |
| MUS485 | SOD1 | scFv | 2A10 construct | Ghadge, G. D. et al., Single chain variable fragment antibodies block aggregation and toxicity induced by familial ALS-linked mutant forms of SOD1, Neurobiol. Dis. (2013), NCBI Accession # AGK37120.1 | 4494 |

Neuropathy Antibodies

In one embodiment, the payload region of the AAV particle comprises one or more nucleic acid sequences encoding one or more of the neuropathy payload antibody polypeptides listed in Table 7 (NEURO1-NEURO65; SEQ ID NO: 3040-3046, 3076, 3124-3130, 3164-3177, 3262-3268, 3285, 3329-3336, 3358-3371, 4495-4500).

TABLE 7

Neuropathy Antibodies

| Antibody No. | Target | Description | Antibody Name | Reference Information | SEQ ID NO |
|---|---|---|---|---|---|
| NEURO1 | trk-C (NT-3 trkC ligand) | Heavy chain | 2250 | U.S. Pat. No. 7,615,383 SEQ ID NO: 42 | 3040 |
| NEURO2 | trk-C (NT-3 trkC ligand) | Heavy chain | 2253 | U.S. Pat. No. 7,615,383 SEQ ID NO: 43 | 3041 |
| NEURO3 | trk-C (NT-3 trkC ligand) | Heavy chain | 2256 | U.S. Pat. No. 7,615,383 SEQ ID NO: 44 | 3042 |
| NEURO4 | trk-C (NT-3 trkC ligand) | Heavy chain | 6.1.2 | U.S. Pat. No. 7,615,383 SEQ ID NO: 45 | 3043 |
| NEURO5 | trk-C (NT-3 trkC ligand) | Heavy chain | 6.4.1 | U.S. Pat. No. 7,615,383 SEQ ID NO: 46 | 3044 |
| NEURO6 | trk-C (NT-3 trkC ligand) | Heavy chain | 2345 | U.S. Pat. No. 7,615,383 SEQ ID NO: 47 | 3045 |
| NEURO7 | trk-C (NT-3 trkC ligand) | Heavy chain | 2349 | U.S. Pat. No. 7,615,383 SEQ ID NO: 48 | 3046 |
| NEURO8 | RTN4 (NOGO) | Heavy chain IgG4, immunomodulator | Atinumab | U.S. Pat. No. 8,163,285 SEQ ID NO: 24 | 3076 |
| NEURO9 | LPG (lysophosphatidyl-glucoside) | Heavy chain variable region | #7 | U.S. Pat. No. 8,591,902 SEQ ID NO: 18 | 3124 |
| NEURO10 | LPG (lysophosphatidyl-glucoside) | Heavy chain variable region | #15 | U.S. Pat. No. 8,591,902 SEQ ID NO: 8 | 3125 |

TABLE 7-continued

| Neuropathy Antibodies | | | | | |
|---|---|---|---|---|---|
| Antibody No. | Target | Description | Antibody Name | Reference Information | SEQ ID NO |
| NEURO11 | MAG | Heavy chain variable region | | U.S. Pat. No. 8,071,731 SEQ ID NO: 13 | 3126 |
| NEURO12 | MAG | Heavy chain variable region | | U.S. Pat. No. 8,071,731 SEQ ID NO: 14 | 3127 |
| NEURO13 | MAG | Heavy chain variable region | | U.S. Pat. No. 8,071,731 SEQ ID NO: 15 | 3128 |
| NEURO14 | MAI (myelin associated inhibitor) | Heavy chain variable region | | WO2013158748 SEQ ID NO: 1 | 3129 |
| NEURO15 | MAI (myelin associated inhibitor) | Heavy chain variable region | | WO2013158748 SEQ ID NO: 17 | 3130 |
| NEURO16 | RAGE protein | Heavy chain variable region | Mab 7F9 | US20130149313 SEQ ID NO: 1 | 4495 |
| NEURO17 | RAGE protein | Heavy chain variable region | Mab 4E5 | US20130149313 SEQ ID NO: 17 | 4496 |
| NEURO18 | RAGE protein | Heavy chain variable region | Mab 11E6 | US20130149313 SEQ ID NO: 9 | 4497 |
| NEURO19 | RGMa | Heavy drain variable region | AE12-1 | US20140023659 SEQ ID NO: 1 | 3164 |
| NEURO20 | RGMa | Heavy chain variable region | AE12-20 | US20140023659 SEQ ID NO: 107 | 3165 |
| NEURO21 | RGMa | Heavy chain variable region | AE12-21 | US20140023659 SEQ ID NO: 115 | 3166 |
| NEURO22 | RGMa | Heavy chain variable region | AE12-23 | US20140023659 SEQ ID NO: 123 | 3167 |
| NEURO23 | RGMa | Heavy chain variable region | AE12-24 | US20140023659 SEQ ID NO: 131 | 3168 |
| NEURO24 | RGMa | Heavy chain variable region | AE12-3 | US20140023659 SEQ ID NO: 17 | 3169 |
| NEURO25 | RGMa | Heavy chain variable region | AE12-4 | US20140023659 SEQ ID NO: 25 | 3170 |
| NEURO26 | RGMa | Heavy chain variable region | AE12-5 | US20140023659 SEQ ID NO: 33 | 3171 |
| NEURO27 | RGMa | Heavy chain variable region | AE12-6 | US20140023659 SEQ ID NO: 41 | 3172 |
| NEURO28 | RGMa | Heavy chain variable region | AE12-7 | US20140023659 SEQ ID NO: 49 | 3173 |
| NEURO29 | RGMa | Heavy chain variable region | AE12-8 | US20140023659 SEQ ID NO: 57 | 3174 |
| NEURO30 | RGMa | Heavy chain variable region | AE12-2 | US20140023659 SEQ ID NO: 9 | 3175 |
| NEURO31 | RGMa | Heavy chain variable region | AE12-13 | US20140023659 SEQ ID NO: 91 | 3176 |
| NEURO32 | RGMa | Heavy chain variable region | AE12-15 | US20140023659 SEQ ID NO: 99 | 3177 |
| NEURO33 | trk-C (NT-3 trkC ligand) | Light chain | 2250 | U.S. Pat. No. 7,615,383 SEQ ID NO: 49 | 3262 |
| NEURO34 | trk-C (NT-3 trkC ligand) | Light chain | 2253 | U.S. Pat. No. 7,615,383 SEQ ID NO: 50 | 3263 |
| NEURO35 | trk-C (NT-3 trkC ligand) | Light chain | 2256 | U.S. Pat. No. 7,615,383 SEQ ID NO: 51 | 3264 |
| NEURO36 | trk-C (NT-3 trkC ligand) | Light chain | 6.1.2 | U.S. Pat. No. 7,615,383 SEQ ID NO: 52 | 3265 |
| NEURO37 | trk-C (NT-3 trkC ligand) | Light chain | 6.4.1 | U.S. Pat. No. 7,615,383 SEQ ID NO: 53 | 3266 |
| NEURO38 | trk-C (NT-3 trkC ligand) | Light chain | 2345 | U.S. Pat. No. 7,615,383 SEQ ID NO: 54 | 3267 |
| NEURO39 | trk-C (NT-3 trkC ligand) | Light chain | 2349 | U.S. Pat. No. 7,615,383 SEQ ID NO: 55 | 3268 |
| NEURO40 | RTN4 | Light chain IgG4, immunomodulator | Atinumab | U.S. Pat. No. 8,163,285 SEQ ID NO: 25 | 3285 |
| NEURO41 | LPG (lysophosphatidyl-glucoside) | Light chain variable region | #7 | U.S. Pat. No. 8,591,902 SEQ ID NO: 17 | 3329 |
| NEURO42 | LPG (lysophosphatidyl-glucoside) | Light chain variable region | #15 | U.S. Pat. No. 8,591,902 SEQ ID NO: 7 | 3330 |
| NEURO43 | MAG | Light chain variable region. | | U.S. Pat. No. 8,071,731 SEQ ID NO: 16 | 3331 |
| NEURO44 | MAG | Light chain variable region | | U.S. Pat. No. 8,071,731 SEQ ID NO: 17 | 3332 |
| NEURO45 | MAG | Light chain variable region | | U.S. Pat. No. 8,071,731 SEQ ID NO: 18 | 3333 |

TABLE 7-continued

Neuropathy Antibodies

| Antibody No. | Target | Description | Antibody Name | Reference Information | SEQ ID NO |
|---|---|---|---|---|---|
| NEURO46 | MAG | Light chain variable region | | U.S. Pat. No. 8,071,731 SEQ ID NO: 19 | 3334 |
| NEURO47 | MAI (myelin associated inhibitor) | Light chain variable region | | WO2013158748 SEQ ID NO: 11 | 3335 |
| NEURO48 | MAI (myelin associated inhibitor) | Light chain variable region | | WO2013158748 SEQ ID NO: 27 | 3336 |
| NEURO49 | RAGE protein | Light chain variable region | Mab 11E6 | US20130149313 SEQ ID NO: 13 | 4498 |
| NEURO50 | RAGE protein | Light chain variable region | Mab 4E5 | US20130149313 SEQ ID NO: 21 | 4499 |
| NEURO51 | RAGE protein | Light chain variable region | Mab 7F9 | US20130149313 SEQ ID NO: 5 | 4500 |
| NEURO52 | RGMa | Light chain variable region | AE12-15 | US20140023659 SEQ ID NO: 103 | 3358 |
| NEURO53 | RGMa | Light chain variable region | AE12-20 | US20140023659 SEQ ID NO: 111 | 3359 |
| NEURO54 | RGMa | Light chain variable region | AE12-21 | US20140023659 SEQ ID NO: 119 | 3360 |
| NEURO55 | RGMa | Light chain variable region | AE12-23 | US20140023659 SEQ ID NO: 127 | 3361 |
| NEURO56 | RGMa | Light chain variable region | AE12-2 | US20140023659 SEQ ID NO: 13 | 3362 |
| NEURO57 | RGMa | Light chain variable region | AE12-24 | US20140023659 SEQ ID NO: 135 | 3363 |
| NEURO58 | RGMa | Light chain variable region | AE12-3 | US20140023659 SEQ ID NO: 21 | 3364 |
| NEURO59 | RGMa | Light chain variable region | AE12-4 | US20140023659 SEQ ID NO: 29 | 3365 |
| NEURO60 | RGMa | Light chain variable region | AE12-5 | US20140023659 SEQ ID NO: 37 | 3366 |
| NEURO61 | RGMa | Light chain variable region | AE12-6 | US20140023659 SEQ ID NO: 45 | 3367 |
| NEURO62 | RGMa | Light chain variable region | AE12-1 | US20140023659 SEQ ID NO: 5 | 3368 |
| NEURO63 | RGMa | Light chain variable region | AE12-7 | US20140023659 SEQ ID NO: 53 | 3369 |
| NEURO64 | RGMa | Light chain variable region | AE12-8 | US20140023659 SEQ ID NO: 61 | 3370 |
| NEURO65 | RGMa | Light chain variable region | AE12-13 | US20140023659 SEQ ID NO: 95 | 3371 |

Psychiatric Disorder Antibodies

In one embodiment, the payload region of the AAV particle comprises one or more nucleic acid sequences encoding one or more of the psychiatric disorder payload antibody polypeptides listed in Table 8 (PSYCH1-PSYCH160; SEQ ID NO: 2977-2998, 3152-3177, 3205-3226, 3350-3371, 4501-4568).

TABLE 8

Psychiatric Disorder Antibodies

| Antibody No. | Target | Description | Antibody Name | Reference Information | SEQ ID NO |
|---|---|---|---|---|---|
| PSYCH1 | ACTH | Heavy chain | Ab4 | WO2015127288 SEQ ID NO: 121 | 2995 |
| PSYCH2 | ACTH | Heavy chain | Ab1.H | WO2015127288 SEQ ID NO: 441 | 2983 |
| PSYCH3 | ACTH | Heavy chain | Ab2.H | WO2015127288 SEQ ID NO: 481 | 2984 |
| PSYCH4 | ACTH | Heavy chain | Ab3.H | WO2015127288 SEQ ID NO: 521 | 2985 |
| PSYCH5 | ACTH | Heavy chain | Ab4.H | WO2015127288 SEQ ID NO: 561 | 2986 |
| PSYCH6 | ACTH | Heavy chain | Ab6.H | WO2015127288 SEQ ID NO: 601 | 2987 |

TABLE 8-continued

Psychiatric Disorder Antibodies

| Antibody No. | Target | Description | Antibody Name | Reference Information | SEQ ID NO |
|---|---|---|---|---|---|
| PSYCH7 | ACTH | Heavy chain | Ab7.H | WO2015127288 SEQ ID NO: 641 | 2988 |
| PSYCH8 | ACTH | Heavy chain | Ab7A.H | WO2015127288 SEQ ID NO: 681 | 2989 |
| PSYCH9 | ACTH | Heavy chain | Ab10.H | WO2015127288 SEQ ID NO: 721 | 2990 |
| PSYCH10 | ACTH | Heavy chain | Ab11.H | WO2015127288 SEQ ID NO: 761 | 2991 |
| PSYCH11 | ACTH | Heavy chain | Ab11A.H | WO2015127288 SEQ ID NO: 801 | 2992 |
| PSYCH12 | ACTH | Heavy chain | Ab5 | WO2015127288 SEQ ID NO: 161 | 2996 |
| PSYCH13 | ACTH | Heavy chain | Ab3 | WO2015127288 SEQ ID NO: 81 | 2993 |
| PSYCH14 | ACTH | Heavy chain | Ab12.H | WO2015127288 SEQ ID NO: 841 | 2994 |
| PSYCH15 | ACTH | Heavy chain | Ab6 | WO2015127288 SEQ ID NO: 201 | 2997 |
| PSYCH16 | ACTH | Heavy chain | Ab7 | WO2015127288 SEQ ID NO: 241 | 2977 |
| PSYCH17 | ACTH | Heavy chain | Ab9 | WO2015127288 SEQ ID NO: 281 | 2978 |
| PSYCH18 | ACTH | Heavy chain | Ab10 | WO2015127288 SEQ ID NO: 321 | 2979 |
| PSYCH19 | ACTH | Heavy chain | Ab11 | WO2015127288 SEQ ID NO: 361 | 2980 |
| PSYCH20 | ACTH | Heavy chain | Ab12 | WO2015127288 SEQ ID NO: 401 | 2981 |
| PSYCH21 | ACTH | Heavy chain | Ab2 | WO2015127288 SEQ ID NO: 41 | 2982 |
| PSYCH22 | ACTH | Heavy chain | Ab1 | WO2015127288 SEQ ID NO: 1 | 2998 |
| PSYCH23 | neuregulin (NRG) | Heavy chain | | US20140363438 SEQ ID NO: 72 | 4501 |
| PSYCH24 | neuregulin (NRG) | Heavy chain | | US20140363438 SEQ ID NO: 74 | 4502 |
| PSYCH25 | Anx-A1 | Heavy chain variable region | VJ-4B6 | US20150004164 SEQ ID NO: 16 | 4503 |
| PSYCH26 | Anx-A1 | Heavy chain variable region | VJ-4B6 | US20150004164 SEQ ID NO: 20 | 4504 |
| PSYCH27 | RGM A | Heavy chain variable region | 5F9.1-GL | US20150183871 SEQ ID NO: 35 | 3152 |
| PSYCH28 | RGM A | Heavy chain variable region | 5F9.2-GL | US20150183871 SEQ ID NO: 36 | 3153 |
| PSYCH29 | RGM A | Heavy chain variable region | 5F9.3-GL | US20150183871 SEQ ID NO: 37 | 3154 |
| PSYCH30 | RGM A | Heavy chain variable region | 5F9.4-GL | US20150183871 SEQ ID NO: 38 | 3155 |
| PSYCH31 | RGM A | Heavy chain variable region | 5F9.5-GL | US20150183871 SEQ ID NO: 39 | 3156 |
| PSYCH32 | RGM A | Heavy chain variable region | 5F9.6-GL | US20150183871 SEQ ID NO: 40 | 3157 |
| PSYCH33 | RGM A | Heavy chain variable region | 5F9.7-GL | US20150183871 SEQ ID NO: 41 | 3158 |
| PSYCH34 | RGM A | Heavy chain variable region | 5F9.8-GL | US20150183871 SEQ ID NO: 42 | 3159 |
| PSYCH35 | RGM A | Heavy chain variable region | 5F9.9-G.L | US20150183871 SEQ ID NO: 43 | 3160 |
| PSYCH36 | RGM A | Heavy chain variable region | h5F9.1, h5F9.1, h5F9.1, h5F9.1, h5F9.1, h5F9.2, h5F9.3 | US20150183871 SEQ ID NO: 47 | 3161 |
| PSYCH37 | RGM A | Heavy chain variable region | h5F9.3, h5F9.9, h5F9.25 | US20150183871 SEQ ID NO: 53 | 3162 |
| PSYCH38 | RGM A | Heavy chain variable region | h5F9.4, h5F9.10, h5F9.26 | US20150183871 SEQ ID NO: 54 | 3163 |
| PSYCH39 | RGMa | Heavy chain variable region | AE12-1 | US20140023659 SEQ ID NO: 1 | 3164 |
| PSYCH40 | RGMa | Heavy chain variable region | AE12-20 | US20140023659 SEQ ID NO: 107 | 3165 |
| PSYCH41 | RGMa | Heavy chain variable region | AE12-21 | US20140023659 SEQ ID NO: 115 | 3166 |
| PSYCH42 | RGMa | Heavy chain variable region | AE12-23 | US20140023659 SEQ ID NO: 123 | 3167 |
| PSYCH43 | RGMa | Heavy chain variable region | AE12-24 | US20140023659 SEQ ID NO: 131 | 3168 |

TABLE 8-continued

Psychiatric Disorder Antibodies

| Antibody No. | Target | Description | Antibody Name | Reference Information | SEQ ID NO |
|---|---|---|---|---|---|
| PSYCH44 | RGMa | Heavy chain variable region | AE12-3 | US20140023659 SEQ ID NO: 17 | 3169 |
| PSYCH45 | RGMa | Heavy chain variable region | AE12-4 | US20140023659 SEQ ID NO: 25 | 3170 |
| PSYCH46 | RGMa | Heavy chain variable region | AE12-5 | US20140023659 SEQ ID NO: 33 | 3171 |
| PSYCH47 | RGMa | Heavy chain variable region | AE12-6 | US20140023659 SEQ ID NO: 41 | 3172 |
| PSYCH48 | RGMa | Heavy chain variable region | AE12-7 | US20140023659 SEQ ID NO: 49 | 3173 |
| PSYCH49 | RGMa | Heavy chain variable region | AE12-8 | US20140023659 SEQ ID NO: 57 | 3174 |
| PSYCH50 | RGMa | Heavy chain variable region | AE12-2 | US20140023659 SEQ ID NO: 9 | 3175 |
| PSYCH51 | RGMa | Heavy chain variable region | AE12-13 | US20140023659 SEQ ID NO: 91 | 3176 |
| PSYCH52 | RGMa | Heavy chain variable region | AE12-15 | US20140023659 SEQ ID NO: 99 | 3177 |
| PSYCH53 | TMEFE2 | Heavy chain variable region | PQ01 | US20150030602 SEQ ID NO: 10 | 4505 |
| PSYCH54 | TNFa | Heavy chain variable region | 2SD4 | US20140296493 SEQ ID NO: 10 | 4506 |
| PSYCH55 | TNFa | Heavy chain variable region | D2E7 | US20140296493 SEQ ID NO: 2 | 4507 |
| PSYCH56 | ghrelin | Heavy chain variable region |  | US20060233788 SEQ ID NO: 12 | 4508 |
| PSYCH57 | ghrelin | Heavy chain variable region |  | US20060233788 SEQ ID NO: 13 | 4509 |
| PSYCH58 | ghrelin | Heavy chain variable region |  | US20060233788 SEQ ID NO: 32 | 4510 |
| PSYCH59 | ghrelin | Heavy chain variable region |  | US20060233788 SEQ ID NO: 33 | 4511 |
| PSYCH60 | neuregulin (NRG) | Heavy chain variable region |  | US20140363438 SEQ ID NO: 21 | 4512 |
| PSYCH61 | neuregulin (NRG) | Heavy chain variable region |  | US20140363438 SEQ ID NO: 52 | 4513 |
| PSYCH62 | neuregulin (NRG) | Heavy chain variable region |  | US20140363438 SEQ ID NO: 54 | 4514 |
| PSYCH63 | neuregulin (NRG) | Heavy chain variable region |  | US20140363438 SEQ ID NO: 56 | 4515 |
| PSYCH64 | neuregulin (NRG) | Heavy chain variable region |  | US20140363438 SEQ ID NO: 58 | 4516 |
| PSYCH65 | neuregulin (NRG) | Heavy chain variable region |  | US20140363438 SEQ ID NO: 60 | 4517 |
| PSYCH66 | neuregulin (NRG) | Heavy chain variable region |  | US20140363438 SEQ ID NO: 62 | 4518 |
| PSYCH67 | neuregulin (NRG) | Heavy chain variable region |  | US20140363438 SEQ ID NO: 63 | 4519 |
| PSYCH68 | neuregulin (NRG) | Heavy chain variable region |  | US20140363438 SEQ ID NO: 64 | 4520 |
| PSYCH69 | neuregulin (NRG) | Heavy chain variable region |  | US20140363438 SEQ ID NO: 66 | 4521 |
| PSYCH70 | neuregulin (NRG) | Heavy chain variable region |  | US20140363438 SEQ ID NO: 68 | 4522 |
| PSYCH71 | neuregulin (NRG) | Heavy chain variable region |  | US20140363438 SEQ ID NO: 70 | 4523 |
| PSYCH72 | ACTH | Light chain | Ab3 | WO2015127288 SEQ ID NO: 101 | 3205 |
| PSYCH73 | ACTH | Light chain | Ab4 | WO2015127288 SEQ ID NO: 141 | 3206 |
| PSYCH74 | ACTH | Light chain | Ab5 | WO2015127288 SEQ ID NO: 181 | 3207 |
| PSYCH75 | ACTH | Light chain | Ab1 | WO2015127288 SEQ ID NO: 21 | 3208 |
| PSYCH76 | ACTH | Light chain | Ab6 | WO2015127288 SEQ ID NO: 221 | 3209 |
| PSYCH77 | ACTH | Light chain | Ab7 | WO2015127288 SEQ ID NO: 261 | 3210 |
| PSYCH78 | ACTH | Light chain | Ab9 | WO2015127288 SEQ ID NO: 301 | 3211 |
| PSYCH79 | ACTH | Light chain | Ab10 | WO2015127288 SEQ ID NO: 341 | 3212 |
| PSYCH80 | ACTH | Light chain | Ab11 | WO2015127288 SEQ ID NO: 381 | 3213 |

TABLE 8-continued

Psychiatric Disorder Antibodies

| Antibody No. | Target | Description | Antibody Name | Reference Information | SEQ ID NO |
|---|---|---|---|---|---|
| PSYCH81 | ACTH | Light chain | Ab12 | WO2015127288 SEQ ID NO: 421 | 3214 |
| PSYCH82 | ACTH | Light chain | Ab1.H | WO2015127288 SEQ ID NO: 461 | 3215 |
| PSYCH83 | ACTH | Light chain | Ab2.H | WO2015127288 SEQ ID NO: 501 | 3216 |
| PSYCH84 | ACTH | Light chain | Ab3.H | WO2015127288 SEQ ID NO: 541 | 3217 |
| PSYCH85 | ACTH | Light chain | Ab4.H | WO2015127288 SEQ ID NO: 581 | 3218 |
| PSYCH86 | ACTH | Light chain | Ab2 | WO2015127288 SEQ ID NO: 61 | 3219 |
| PSYCH87 | ACTH | Light chain | Ab6.H | WO2015127288 SEQ ID NO: 621 | 3220 |
| PSYCH88 | ACTH | Light chain | Ab7.H | WO2015127288 SEQ ID NO: 661 | 3221 |
| PSYCH89 | ACTH | Light chain | Ab7A.H | WO2015127288 SEQ ID NO: 701 | 3222 |
| PSYCH90 | ACTH | Light chain | Ab10.H | WO2015127288 SEQ ID NO: 741 | 3223 |
| PSYCH91 | ACTH | Light chain | Ab11.H | WO2015127288 SEQ ID NO: 781 | 3224 |
| PSYCH92 | ACTH | Light chain | Ab11A.H | WO2015127288 SEQ ID NO: 821 | 3225 |
| PSYCH93 | ACTH | Light chain | Ab12.H | WO2015127288 SEQ ID NO: 861 | 3226 |
| PSYCH94 | neuregulin (NRG) | Light chain | | US20140363438 SEQ ID NO: 73 | 4524 |
| PSYCH95 | neuregulin (NRG) | Light chain | | US20140363438 SEQ ID NO: 75 | 4525 |
| PSYCH96 | Anx-A1 | Light chain variable region | VJ-4B6 | US20150004164 SEQ ID NO: 15 | 4526 |
| PSYCH97 | Anx-A1 | Light chain variable region | VJ-4B6 | US20150004164 SEQ ID NO: 19 | 4527 |
| PSYCH98 | RGM A | Light chain variable region | 5F9.1-GL, 5F9.1-GL, 5F9.1-GL, 5F9.1-GL, 5F9.1-GL, 5F9.1-GL, 5F9.1-GL, 5F9.1-GL, h5F9.4, h5F9.11, h5F9.12 | US20150183871 SEQ ID NO: 44 | 3350 |
| PSYCH99 | RGM A | Light chain variable region | 5F9.2-GL, 5F9.2-GL, 5F9.2-GL, 5F9.2-GL, 5F9.2-GL, 5F9.2-GL, 5F9.2-GL, 5F9.2-GL, h5F9.5, h5F9.19, h5F9.20 | US20150183871 SEQ ID NO: 45 | 3351 |
| PSYCH100 | RGM A | Light chain variable region | 5F9.3-GL, 5F9.3-GL, 5F9.3-GL, 5F9.3-GL, 5F9.3-GL, 5F9.3-GL, 5F9.3-GL, 5F9.3-GL, h5F9.6, h5F9.21, h5F9.22 | US20150183871 SEQ ID NO: 46 | 3352 |
| PSYCH101 | RGM A | Light chain variable region | h5F9.5, h5F9.6, h5F9.7, h5F9.8, h5F9.9, h5F9.10 | US20150183871 SEQ ID NO: 48 | 3353 |
| PSYCH102 | RGM A | Light chain variable region | h5F9.11, h5F9.19, h5F9.21 | US20150183871 SEQ ID NO: 49 | 3354 |
| PSYCH103 | RGM A | Light chain variable region | h5F9.12, h5F9.20, h5F9.22, h5F9.23, h5F9.25, h5F9.26 | US20150183871 SEQ ID NO: 50 | 3355 |
| PSYCH104 | RGM A | Light chain variable region | h5F9.1, h5F9.7, h5F9.23 | US20150183871 SEQ ID NO: 51 | 3356 |
| PSYCH105 | RGM A | Light chain variable region | h5F9.2, h5F9.8, h5F9.25 | US20150183871 SEQ ID NO: 52 | 3357 |
| PSYCH106 | RGMa | Light chain variable region | AE12-15 | US20140023659 SEQ ID NO: 103 | 3358 |
| PSYCH107 | RGMa | Light chain variable region | AE12-20 | US20140023659 SEQ ID NO: 111 | 3359 |
| PSYCH108 | RGMa | Light chain variable region | AE12-21 | US20140023659 SEQ ID NO: 119 | 3360 |

TABLE 8-continued

Psychiatric Disorder Antibodies

| Antibody No. | Target | Description | Antibody Name | Reference Information | SEQ ID NO |
|---|---|---|---|---|---|
| PSYCH109 | RGMa | Light chain variable region | AE12-23 | US20140023659 SEQ ID NO: 127 | 3361 |
| PSYCH110 | RGMa | Light chain variable region | AE12-2 | US20140023659 SEQ ID NO: 13 | 3362 |
| PSYCH111 | RGMa | Light chain variable region | AE12-24 | US20140023659 SEQ ID NO: 135 | 3363 |
| PSYCH112 | RGMa | Light chain variable region | AE12-3 | US20140023659 SEQ ID NO: 21 | 3364 |
| PSYCH113 | RGMa | Light chain variable region | AE12-4 | US20140023659 SEQ ID NO: 29 | 3365 |
| PSYCH114 | RGMa | Light chain variable region | AE12-5 | US20140023659 SEQ ID NO: 37 | 3366 |
| PSYCH115 | RGMa | Light chain variable region | AE12-6 | US20140023659 SEQ ID NO: 45 | 3367 |
| PSYCH116 | RGMa | Light chain variable region | AE12-1 | US20140023659 SEQ ID NO: 5 | 3368 |
| PSYCH117 | RGMa | Light chain variable region | AE12-7 | US20140023659 SEQ ID NO: 53 | 3369 |
| PSYCH118 | RGMa | Light chain variable region | AE12-8 | US20140023659 SEQ ID NO: 61 | 3370 |
| PSYCH119 | RGMa | Light chain variable region | AE12-13 | US20140023659 SEQ ID NO: 95 | 3371 |
| PSYCH120 | TMEFE3 | Light chain variable region | PQ01 | US20150030602 SEQ ID NO: 12 | 4528 |
| PSYCH121 | TNFa | Light chain variable region | D2E7 | US20140296493 SEQ ID NO: 1 | 4529 |
| PSYCH122 | TNFa | Light chain variable region | 2SD4 | US20140296493 SEQ ID NO: 9 | 4530 |
| PSYCH123 | ghrelin | Light chain variable region | | US20060233788 SEQ ID NO: 3 | 4531 |
| PSYCH124 | ghrelin | Light chain variable region | | US20060233788 SEQ ID NO: 30 | 4532 |
| PSYCH125 | ghrelin | Light chain variable region | | US20060233788 SEQ ID NO: 31 | 4533 |
| PSYCH126 | ghrelin | Light chain variable region | | US20060233788 SEQ ID NO: 4 | 4534 |
| PSYCH127 | neuregulin (NRG) | Light chain variable region | | US20140363438 SEQ ID NO: 22 | 4535 |
| PSYCH128 | neuregulin (NRG) | Light chain variable region | | US20140363438 SEQ ID NO: 23 | 4536 |
| PSYCH129 | neuregulin (NRG) | Light chain variable region | | US20140363438 SEQ ID NO: 24 | 4537 |
| PSYCH130 | neuregulin (NRG) | Light chain variable region | | US20140363438 SEQ ID NO: 25 | 4538 |
| PSYCH131 | neuregulin (NRG) | Light chain variable region | | US20140363438 SEQ ID NO: 26 | 4539 |
| PSYCH132 | neuregulin (NRG) | Light chain variable region | | US20140363438 SEQ ID NO: 27 | 4540 |
| PSYCH133 | neuregulin (NRG) | Light chain variable region | | US20140363438 SEQ ID NO: 53 | 4541 |
| PSYCH134 | neuregulin (NRG) | Light chain variable region | | US20140363438 SEQ ID NO: 55 | 4542 |
| PSYCH135 | neuregulin (NRG) | Light chain variable region | | US20140363438 SEQ ID NO: 57 | 4543 |
| PSYCH136 | neuregulin (NRG) | Light chain variable region | | US20140363438 SEQ ID NO: 59 | 4544 |
| PSYCH137 | neuregulin (NRG) | Light chain variable region | | US20140363438 SEQ ID NO: 61 | 4545 |
| PSYCH138 | neuregulin (NRG) | Light chain variable region | | US20140363438 SEQ ID NO: 65 | 4546 |
| PSYCH139 | neuregulin (NRG) | Light chain variable region | | US20140363438 SEQ ID NO: 67 | 4547 |
| PSYCH140 | neuregulin (NRG) | Light chain variable region | | US20140363438 SEQ ID NO: 69 | 4548 |
| PSYCH141 | neuregulin (NRG) | Light chain variable region | | US20140363438 SEQ ID NO: 71 | 4549 |
| PSYCH142 | neurokinin B | Single chain scFv | N024C01 | U.S. Pat. No. 7,514,079 SEQ ID NO: 22 | 4550 |
| PSYCH143 | neurokinin B | Single chain scFv | N025B07 | U.S. Pat. No. 7,514,079 SEQ ID NO: 23 | 4551 |
| PSYCH144 | neurokinin B | Single chain scFv | N015E08 | U.S. Pat. No. 7,514,079 SEQ ID NO: 24 | 4552 |
| PSYCH145 | neurokinin B | Single chain scFv | N015F10 | U.S. Pat. No. 7,514,079 SEQ ID NO: 25 | 4553 |

TABLE 8-continued

Psychiatric Disorder Antibodies

| Antibody No. | Target | Description | Antibody Name | Reference Information | SEQ ID NO |
|---|---|---|---|---|---|
| PSYCH146 | neurokinin B | Single chain scFv | N024D01 | U.S. Pat. No. 7,514,079 SEQ ID NO: 26 | 4554 |
| PSYCH147 | neurokinin B | Single chain scFv | N015D08 | U.S. Pat. No. 7,514,079 SEQ ID NO: 27 | 4555 |
| PSYCH148 | neurokinin B | Single chain scFv | N024B07 | U.S. Pat. No. 7,514,079 SEQ ID NO: 28 | 4556 |
| PSYCH149 | neurokinin B | Single chain scFv | N024E07 | U.S. Pat. No. 7,514,079 SEQ ID NO: 29 | 4557 |
| PSYCH150 | neurokinin B | Single chain scFv | N023F05 | U.S. Pat. No. 7,514,079 SEQ ID NO: 30 | 4558 |
| PSYCH151 | neurokinin B | Single chain scFv | N024D08 | U.S. Pat. No. 7,514,079 SEQ ID NO: 31 | 4559 |
| PSYCH152 | neurokinin B | Single chain scFv | N023B03 | U.S. Pat. No. 7,514,079 SEQ ID NO: 32 | 4560 |
| PSYCH153 | neurokinin B | Single chain scFv | N023E01 | U.S. Pat. No. 7,514,079 SEQ ID NO: 33 | 4561 |
| PSYCH154 | neurokinin B | Single chain scFv | N024C05 | U.S. Pat. No. 7,514,079 SEQ ID NO: 34 | 4562 |
| PSYCH155 | neurokinin B | Single chain scFv | N025E05 | U.S. Pat. No. 7,514,079 SEQ ID NO: 35 | 4563 |
| PSYCH156 | neurokinin B | Single chain scFv | N025C01 | U.S. Pat. No. 7,514,079 SEQ ID NO: 36 | 4564 |
| PSYCH157 | neurokinin B | Single drain scFv | N024F09 | U.S. Pat. No. 7,514,079 SEQ ID NO: 37 | 4565 |
| PSYCH158 | neurokinin B | Single chain scFv | N024B01 | U.S. Pat. No. 7,514,079 SEQ ID NO: 38 | 4566 |
| PSYCH159 | neurokinin B | Single chain scFv | N024F07 | U.S. Pat. No. 7,514,079 SEQ ID NO: 39 | 4567 |
| PSYCH160 | neurokinin B | Single chain scFv | N015D10 | U.S. Pat. No. 7,514,079 SEQ ID NO: 40 | 4568 |

Cancer, Inflammation and Immune System Antibodies

In one embodiment, the payload region of the AAV particle comprises one or more nucleic acid sequences encoding one or more of the cancer, inflammation and immune system payload antibody polypeptides listed in Table 9 (CH1-CH13310; SEQ ID NO: 2977-2998, 3031-3039, 3060-3076, 3129-3147, 3181-3196, 3205-3226, 3277-3285, 3335-3345, 3375-3382, 3453-3459, 3856, 3890-3898, 4232-4237, 4308, 4323, 4420, 4431, 4501-4504, 4512-4527, 4535-17658).

Lengthy table referenced here

US11326182-20220510-T00001

Please refer to the end of the specification for access instructions.

In Table 9, the target number (Target No.) code is described in the following semi-colon delimited list where the target number is followed by the target (e.g., Target No. 1 with target AC133 is shown as Target No. 1-Target AC133). The targets represented by the codes in Table 9 include, but are not limited to, Target No. 1-Target AC133, Target No. 2-Target ACTH; Target No. 3-Target activin receptor-like kinase 1 (ALK-1); Target No. 4-Target ADAMTS4; Target No. 5-Target AFP; Target No. 6-Target Albumin; Target No. 7-Target ALCAM; Target No. 8-Target alpha-4 integrin; Target No. 9-Target angiopoietin 2 (ANGPT2; ANG-2); Target No. 10-Target angiopoietin 2 (ANGPT2; ANG-2) (ANGPT2; ANG-2); Target No. 11-Target Annexin IV or a phospholipid; and (b) a complement inhibitor; Target No. 12-Target Anti-CD-3; Target No. 13-Target antiHER2; Target No. 14-Target anti-Her2 and anti-Her3; Target No. 15-Target antiHER.3; Target No. 16-Target anti-idiotype (Id); Target No. 17-Target Anx-A1; Target No. 18-Target AOC3 (VAP-1); Target No. 19-Target Alpha-V integrins Target No. 20-Target AXL, Target No. 21-Target B and T human lymphocytes; Target No. 22-Target b7 subunit of a4b7, aEb7 integrins, humanized IgG1; Target No. 23-Target B7-H1; Target No. 24-Target B7-H3; Target No. 25-Target B7-H4; Target No. 26-Target B7-H5: Target No. 27-Target B7-H6; Target No. 28-Target B7-H7, Target No. 29-Target B7-H8; Target No. 30-Target BMP9; Target No. 31-Target BSG; Target No. 32-Target C3b, Target No. 33-Target C3b, Properdin (factor P), Factors Ba and Bb, C5, C6, C7, C8, C9; Target No. 34-Target C5, Target No 35-Target C5a; Target No. 36-Target C5d polypeptide; Target No. 37-Target CA 125 (MUC16); Target No. 38-Target CA-125 (imitation); Target No. 39-Target C-antigen; Target No. 40-Target Carbohydrate Antigen 242 (CA242); Target No. 41-Target carbonic anhydrase 9(CA-1X); Target No. 42-Target CC chemokines; Target No. 43-Target CCL11 (eotaxin-1); Target No. 44-Target CCL2, MCP-1, MCAF; Target No. 45-Target CCR2; Target No. 46-Target CCR4; Target No. 47-Target CD100; Target No. 48-Target CD11; Target No. 49-Target CD11a; Target No. 50-Target CD123; Target No. 51-Target CD147 (basigin); Target No. 52-Target CD154 (CD40LG); Target No. 53-Target CD19; Target No. 54-Target CD19; Target No. 55-Target CD2; Target No. 56-Target CD20; Target No. 57-Target CD20/CD40; Target No. 58-Target CD20/EGFR; Target No. 59-Target CD200; Target No 60-Target CD22; Target No. 61-Target CD221; Target No. 62-Target CD248 (TEM-1); Target No. 63-Target CD27; Target No. 64-Target CD274 (PD-L1); Target No. 63-Target CD28; Target No. 66-Target CD3; Target No. 67-Target CD3; Target No. 68-Target CD3 epsilon; Target No. 69-Target CD3 epsilon, anti-IL1-Ri; Target No. 70-Target CD3, CD19; Target No. 71-Target CD3, EpCAM; Target No. 72-Target CD3. MSCP; Target No. 73-Target CD3/CD19 or CD3/CD20; Target No. 74-Target CD3; CD19; Target No. 75-Target CD30; Target No. 76-Target CD31; Target No. 77-Target CD32; Target No. 78-Target CD324/E-cadherin; Target No. 79-Target CD32b; Target No. 80-Target CD33; Target No. 81-Target CD34; Target No. 82-Target CD35; Target No. 83-Target CD37; Target No. 84-Target CD37 and CD20, Target No. 85-Target CD38; Target No. 86-Target CD38, human IgG1; Target No. 87-Target CD38, human IgG2; Target No. 88-Target CD3E; Target No. 89-Target CD3E, EPCAM; Target No. 90-Target CD3E, EPCAM (IL-beta); Target No. 91-Target CD4; Target No. 92-Target CD40; Target No. 93-Target CD40LG; Target No. 94-Target CD44 v6; Target No. 95-Target CD-49d, CD11a; Target No. 96-Target CD51; Target No. 97-Target CD52; Target No. 98-Target CD55/CD59 and CD20; Target No. 99-Target CD6; Target No. 100-Target CD64; Target No. 101-Target CD70; Target No. 102-Target CD74; Target No. 103-Target CD79B; Target No. 104-Target CD89, Target No. 105-Target CEA; Target No. 106-Target CEACAM5; Target No. 107-Target Cell surface targets; Target No. 108-Target CH region of an immunoglobulin; Target No. 109-Target c-MET; Target No. 110-Target c-MET/EGFR; Target No. 111-Target c-MET/EGFR; c-MET; Target No. 112-Target c-MET/EGFIR; EGFR; HGF; Target No. 113-Target c-MET/FGFR; Target No. 114-Target c-MET/HER; Target No. 115-Target c-MET/HER; ErbB2; Target No. 116-Target c-MET; EGFR; VEGF; c-MET/EGER; Target No. 117-Target CSAp; Target No. 118-Target CSF1R; Target No. 119-Target CSF2; Target No. 120-Target CSF2RA; Target No. 121-Target CSPG4; Target No. 122-Target CTGF; Target No. 123-Target CTLA4; Target No. 124-Target CTLA4, human igG2; Target No. 125-Target CTLA4, human IgG3; Target No. 126-Target C-X-C chemokine receptor type 4; Target No. 127-Target CXCL10; Target No. 128-Target CXCL13; Target No. 129-Target CXCR4; Target No. 130-Target difucosyl Lewis blood group antigens Y-6 and B-7-2; Target No. 131-Target DKK1; Target No. 132-Target DLL3; Target No. 133-Target DLL4; Target No. 134-Target DNA/histone complex; Target No. 135-Target DPP4, CD26; Target No. 136-Target DR5; Target No. 137-Target EFNA1; Target No. 138-Target EGF; Target No. 139-Target EGF7; Target No. 140-Target EGFR; Target No. 141-Target EGFR (EGFRvIII); Target No. 142-Target EGFR (HER1); Target Na. 143-Target EGFR and IGF1R; Target No. 144-Target EGFR family; Target No. 145-Target EGFR, ERBB1, HER1; Target No. 146-Target EGFR. ERBB1, HER2; Target No. 147-Target EGFR, HER2, or HER3; Target No. 148-Target EGFR/cMet; Target No. 149-Target EGFR/HER 3; Target No. 150-Target EGER/VEGFR/HER; Target No. 151-Target EGFR; c-Met; Target No. 152-Target EGFR; VEGF; Target No. 153-Target EGERvIII; Target No. 154-Target EGP-1 (TROP2); Target No. 155-Target EMP2; Target No. 156-Target endoglin; Target No. 157-Target EPCAM; Target No. 158-Target EpCAM, CD3; Target No. 159-Target EphA2 receptor; Target No. 160-Target EPHA3; Target No. 161-Target EphA3; EGFR; HER2; PD-L1; HGF; Target No. 162-Target episialin; Target No. 163-Target ERB2; Target No. 164-Target ERBB; Target No. 165-Target ERBB1; Target No. 166-Target ERBB2; Target No. 167-Target ERBB3; Target No. 168-Target ErbB3/IGF1R; Target No. 169-Target ErbB4; Target No. 170-Tantet ErbB5; Target No. 171-Tantet ErbB6; Target No. 172-Target ErbB7; Target No. 173-Target ErbB8; Target No. 174-Target euGc, NGNA; Target No. 175-Target F3; Target No. 176-Target FAP; Target No. 177-Target FAPα; Target No. 178-Target FasR; Target No. 179-Target FcRn; Target No. 180-Target FcγRIIB (FcγR); Target No. 181-Target FcγRIIB; Target No. 182-Target FcγRIIIA; Target No. 183-Target FGF-8; Target No. 184-Target FGFR2; Target No. 185-Target fibronectin ED-A; Target No. 186-Target fibronectin IIICS isoform; Target No. 187-Target fibronectin extra domain-B; Target No. 188-Target FLT1; Target No. 189-Target FLT3; Target No. 190-Target folate receptor alpha; Target No. 191-Target FOLR1; Target No. 192-Target Frizzled receptor; Target No. 193-Target ganglioside; Target No. 194-Target GD2; Target No. 195-Target GD2/DOTA; Target No. 196-Target GD2/huOKT3; Target No. 197-Target GD3; Target No. 198-Target GD3 ganglioside; Target No. 199-Target GFRα3; Target No. 200-Target glycan antigen; Target No. 201-Target glypican 3; Target No. 202-Target GM2; Target No. 203-Target GPNMB; Target No. 204-Target Growth factor 7; Target No. 205-Target GUCY2C, anti-GCC; Target No. 206-Target HB-EGF; Target No. 207-Target HB-EGF/EGFR; Target No. 208-Target hen egg lysozyme, Target No. 209-Target HER/EGFR; Target No. 210-Target HER1, HER3, CD80, CD86, PD-1, CTLA4, B7-H4, RON, CD200, CD4, BAF R, EGFR, IGFR, VEGFR, a member of the TNF family of receptors, a Tie receptor, MET, IGF1, IGF2, TNF, a INF ligand, IL-6, TWEAK, Fn14, CD20, CD23, CRIPTO, HGF, alpha4beta1 integrin, alpha5beta1 integrin, alpha6beta4 integrin, and alphaVbeta6 integrin; Target No. 211-'Target HER2; Target No. 212-Target HER2/CD3; Target No. 213-Target HER2/Dig; Target No. 214-Target HER2/neu; Target No. 215-Target HER3; Target No. 216-Target HER3, human IgG1; Target No. 217-Target HOF; Target No. 218-Target hIL-12; Target No. 219-Target hIL13; Target No. 220-Target HIV gp120; Target No. 221-Target HLA-DR; Target No. 222-Target hNav1.7; Target No. 223-Target hPG; Target No. 224-Target human TNF; Target No. 225-Target huTNFR, Target No. 226-Target huTNFR1; Target No. 227-Target ICAM-1; Target No. 228-Target IFNAR1; Target No. 229-Target IFN-α; Target No. 230-Target IGF; Target No. 231-Target IGF; IGF1R; Target No. 232-Target IGF1; Target No. 233-Target IGF1R; Target No. 234-Target IGF1R/Dig; Target No. 235-Target IGF-1R/ErbB3; Target No. 236-Target IGF1R; EGFR; Target No. 237-Target IgG4 (CD40); Target No. 238-Target IGHE; Target No. 239-Target IL1; Target No. 240-Target IL10; Target No, 241-Target IL11; Target No. 242-Target IL12; Target No. 243-Target IL12B, IL12 p40, NKSF2, CMLF p40; Target No. 244-Target IL12B, IL12 p40, NKSF2, CMLF p41; Target No. 245-Target IL12p40; Target No. 246-Target IL13; Target No. 247-Target IL13, Human IgG4; Target No. 248-Target IL13, Human IgG5; Target No. 243-Target IL17; Target No. 250-Target IL17A; Target No. 251-Target IL17A and IL17F; Target No. 252-Target IL17RA; Target No. 253-Target IL18; Target No. 254-Target IL18BP; Target No. 255-Target IL1A; Target No. 256-Target IL113; Target No. 257-Target 11,20; Target No. 258-Target 11,20, NOF; Target No, 259-Target IL22; Target No. 260-Target IL23A; Target No. 261-Target IL23p19 subunit humanized IgG1; Target No. 262-Target IL23p19 subunit, humanized IgG2; Target No. 263-Target IL2RA; Target No. 264-Target IL31RA; Target No. 265-Target IL4; Target No. 266-Target IL4R; Target No. 267-Target IL5; Target No. 268-Target IL5RA; Target No. 269-Target IL6: Target No. 270-Target IL6R; Target No. 271-Target IL6R, humanized IgG2; Target No. 272-Target IL7; Target No. 273-Target IL7R; Target No. 274-Target IL8; Target No. 275-Target IL9; Target No. 276-Target ILGF2; Target No. 277-Target Integrin 2; Target No. 278-Target integrin α4β7; Target No. 279-Target integrin α4β8; Target No. 280-Target IP-10; Target No. 281-Target IS12B; Target No. 282-Target ITGA2; Target No. 283-Target ITGA4_ITGB7; Target No. 284-Target ITGAL; Target No. 285-Target ITGAV_ITGB3; Target No. 286-Target ITGAV_ITGB3; Target No. 287-Target KDR; Target No. 288-Target KIR2; Target No. 289-Target KIR2D; Target No. 290-Target KLRC1; Target No. 291-Target LAG-3; Target No. 292-Target LecLe.sup.x, Le.sup.aLe.sup.x, Di-Le.sup.a, Le.sup.x containing glycans and Le.sup.a containing glycans; Target No. 293-Target Lewis b (LeB); Target No. 294-Target Lewis Y (LeY); Target No. 295-Target LIGHT/HER2/CD23; Target No. 296-Target LIGHT/HER2/CD24; Target No. 297-Target LIGHT/HER2/CD25; Target No. 298-Target LIGHT/HER2/CD26; Target No 299-Target LIGHT/HER2/CD27; Target No. 300-Target LIGHT/HER2/CD28; Target No. 301-Target LIGHT/HER2/CD29; Target No. 302-Target LIGHT/HER2/CD30; Target No. 303-Target LIGHT/HER2/CD31; Target No. 304-Target LIGHT/HER2/CD32; Target No. 305-Target LINGO-1; Target No. 306-Target LOXL2; Target No. 307-Target LTA; Target No. 308-Target MAGE-A3; Target No. 309-Target MAI (myelin associated inhibitor); Target No. 310-Target many targets; Target No. 311-Target MCP-1; Target No. 312-Target MCP-2; Target No. 313-Target MCP-3; Target No. 314-Target MCP-4; Target No. 315-Target MCP-5; Target No. 316-Target MCP-6; Target No. 317-Target MCSP; Target No. 318-Target MEK; Target No. 319-Target mesothelin; Target No. 320-Target MET; Target No. 321-Target MET Receptor; Target No. 322-Target MHC; Target No. 323-Target WIC class II; Target No. 324-Target MIF; Target No. 325-Target MMP3; Target No. 326-Target molecules on brain microvascular endothelial cells; Target No. 327-Target monosialo-GM2; Target No. 328-Target MS4A1; Target No. 329-Target MSLN; Target No. 330-Target MST1R; Target No. 331-Target MT4-MMP/EGFR; Target No. 332-Target MTX and EGFR; Target No. 333-Target MTX and hCD-20; Target No. 334-Target MTX and hCD-3; Target No. 335-Target MTX and mCD-3; Target No. 336-Target MUC1; Target No. 337-Target MUC1/MUC5ac; Target No. 338-Target MUC5AC; Target No. 339-Target mucin CanAg; Target No. 340-Target N terminus end of properdin; Target No. 341-Target NCAM1; Target No. 342-Target NeuGc, NGNA; Target No. 343-Target neuregulin (NRG); Target No. 344-Target neurokinin B; Target No. 345-Target neurotensin; Target No. 346-Target NGF; Target No. 347-Target NGF; c-MET; Target No. 348-Target N-glycolyl-GM3; Target No. 349-Target NMDA; Target No. 350-Target NOGO; Target No. 351-Target Nogo receptor-1; Target No. 352-Target Notch receptor; Target No. 353-Target NOTCH1; Target No. 354-Target NRP1; Target No. 355-Target O-acetylated-GD2; Target No. 356-Target OPGL; Target No. 357-Target OX-40; Target No. 358-Target oxLDL; Target No. 359-Target PAM4 antigens; Target No. 360-Target PD-1; Target No. 361-Target PD1, human IgG4, Target No. 362-Target PDGFRA; Target No. 363-Target PDGFR-beta; Target Inc. 364-Target PDGFRβ/VEGFA; Target No. 365-Target PD-L1; Target No. 366-Target PD-L1, human IgG1; Target No. 367-Target PD-L2; Target No. 368-Target periostin; Target No. 369-Target PERP; Target No. 370-Target PhosphatidyL-serine, chimeric IgG1; Target No. 371-Target PhosphatidyL-serine, Chimeric IgG2; Target No. 372-Target polyubiquitin; Target No. 373-Target PSMA; Target No. 374-Target PVRL4; Target No. 375-Target PVRL5; Target No. 376-Target RANKL, Target No. 377-Target RANKL/PTH; Target No. 378-Target RFB4; Target No. 379-Target RON, Target No. 380-Target RTN4 (NOGO); Target No. 381-Target S1P4; Target No. 382-Target SDC1; Target No. 383-Target selectin; Target No. 384-Target Serum albumin (mouse); Target No. 385-Target Serum albumin or neonatal Pc receptor; Target No. 386-Target sialic acid (Neu5Gc or Neu5Ac); Target No. 387-Target sialyl Tn (sTn), Target No. 388-Target Sialyl-Levis A (sLeA); Target No. 389-Target sialyltetraosyl carbohydrate (Colo205); Target No. 390-Target SIRPα; Target No. 391-Target SLAMF7; Target No. 392-Target SLC34A2; Target No. 393-Target SOST; Target No. 394-Target STEAP1; Target No. 395-Target sTn; Target No. 396-Target TAC; Target No. 397-Target TAG-72; Target No. 398-Target Tenascin (TNC-A1 or TNC-A4); Target No. 399-Target Tenascin (TNC-A2); Target No. 400-Target tenascin C; Target No. 401-Target tenascin W; Target No. 402-Target tenascin; Target No. 403-Target Ten-M2; Target No. 404-Target TGF beta 1; Target No. 405-Target TGFbeta; Target No. 406-Target TGF-α; Target No. 407-Target TIGIT; Target No. 408-Target TIM-3; Target No. 409-Target TLR3; Target No. 410-Target Tn antigen; Target No. 411-Target Tn-(MUC1); Target No. 412-Target TNF; Target No. 413-Target TNFalpha, Target No. 414-Target TNFRSF10B; Target No. 415-Target TNFRSF12A; Target No. 416-Target TNFRSF8; Target No. 417-Target TNFRSF9; Target No. 418-Target TNFSF11; Target No. 419-Target TNFSF13B; Target No. 420-Target TPBG; Target No. 421-Target TRAIL-R2; Target No. 422-Target TrkA; Target No. 423-Target TSLP; Target No. 424-Target tumor associated carbohydrate antigen (TACA); Target No. 425-Target tumor specific glycosylation MUC1; Target No. 426-Target tumor-associated calcium signal transducer 2; Target No. 427-Target TYRP1(glycoprotein 75); Target No. 428-Target VEGF; Target No. 429-Target VEGF, c-Met, CD20, CD38, CD25, CD74, FcalphaR1, FcepsilonRI, acetyl choline receptor, fas, fasL, TRAIL hepatitis virus, hepatitis C virus, envelope E2 of hepatitis C virus, tissue factor, a complex of tissue factor and Factor VII, EGFr, CD4, and CD28; Target No. 430-Target VEGF A; Target No. 431-Target VEGFA, ANGT2; Target No. 432-Target VEGFR2; Target No. 433-Target vimentin; Target No. 434-Target VRGF; Target No. 435-Target VSTM5; Target No. 436-Target VWF; Target No. 437-Target α6β4 integrins Target No. 438-Target α-folate receptor, αvβ6integrin, BCMA, B7-H3, B7-H6, CAIX, CD19, CD20, CD22, CD30, CD33, CD37, CD44, CD44v6, CD44v7/8, CD70, CD123, CD138, CD171, CEA, DLL4, EGP-2, EGP-40, CSPG4, EGFR, EGFR family including ErbB2 (HER2), EGFRvIII, EPCAM, EphA2, EpCAM, FAP, FBP, fetal acetylcholine receptor, Fzd7, GD2, GD3, Glypican-3 (GPC3), h5T4, IL-11Rα, IL13R-α2, KDR, κ light chain, λ light chain, LeY, L1CAM, MAGE-A1, mesothelin. MHC presented peptides, MUC1, MUC16, NCAM, NKG2D ligands, Notch1, Notch2/3, NY-ESO-1, PRAME, PSCA, PSMA, Survivin, TAG-72, TEMs, TERT, VEGPR2, and ROR1; and Target No. 439-Target αβv6 integrin.

In Table 9, the description number (Description No.) code is described in the following semi-colon delimited list where the description number is followed by the description (e.g., Description No. 1 with description aglycosylated antibody is shown as Description No. 1-Description aglycosylated antibody). The targets represented by the codes in Table 9 include, but are not limited to, Description No. 1—Descriptionaglycosylated antibody; Description No. 2—DescriptionAmplified variable region; Description No. 3—DescriptionAmtibody; Description No. 4—DescriptionAntibody for Pulmonary Fibrosis; Description No. 5-DescriptionBinding peptide; Description No. 6—DescriptionBispecitic; Description No. 7—Descriptionbispecific antibody; Description No. 8—DescriptionBR96 scFv; Description No. 9—DescriptionChain A, Human Igg1 Fc Frament; Description No. 10-DescriptionChain B, Human Igg1 Fc Fragment;

Description No. 11—DescriphonChimeric antigen receptor with cd19 Binding domain; Description No. 12—DescriptionConsensus sequence; Description No. 13—DescriptionConstant region; Description No. 14—DescriptionConstant region IgG1; Description No. 15—DescriptionConstant region IgG2; Description No. 16—DescriptionConstant region IgG3; Description No. 17—DescriptionConstruct; Description No. 18—DescriptionDiabody; Description No. 19—DescriptionDomain antibody; Description No. 20—DescriptiondsFv; Description No. 21—DescriptionDVD heavy chain; Description No. 22—DescriptionDVD light chain; Description No. 23—DescriptionEGFR-specific variable region and CH2 region; Description No. 24—DescriptionFab Heavy chain; Description No. 25—Description Fab heavy chain-Fc; Description No. 26—Description Fc; Description No. 27—Description Fc domain; Description No. 28—Description Fc polypeptide; Description No. 29—Description fc region Igg1; Description No. 30—Description fibronectin type III (FN3) domain; Description No. 31—Description first Fc domain, isoleucine zipper, IgG2 hinge, and second Fc domain; Description No. 32—Description fragment crystallizable region Description No. 33—Description full sequence; Description No. 34—Description fusion construct; Description No. 35—Description fusion protein; Description No. 36—Description Fusion protein, bispecific; Description No. 37—Description Fusion protein, tumor suppressor protein epha7ecd; Description No. 38—Description Germline Heavy Chainvariable region; Description No. 39—Description Heavy chain variable region; Description No. 40—Description Heavy chain; Description No. 41—Description Heavy chain—constant region; Description No. 42—Description Heavy Chain—variable region; Description No. 43—Description Heavy Chain (Genetic Recombination), Antibody for paroxysmal nocturnal hemoglobinuria; Description No. 44—Description Heavy chain 1; Description No. 45—Description Heavy Chain I, Antibody for immunosuppressant; Description No. 46—Description Heavy chain 2; Description No. 47—Description Heavy chain A; Description No. 48—Description Heavy chain amino acid sequence humanized; Description No. 49—Description Heavy chain antigen binding region; Description No. 50—Description Heavy chain B; Description No. 51—Description Heavy chain camelidae antibodies; Description No. 52—Description Heavy chain CDR; Description No. 53—Description Heavy Chain CDR 1, immunesuppressant; Description No. 54—Description Heavy Chain CDR 2, immunesuppressant; Description No. 55—Description Heavy Chain CDR 3, immunesuppressant; Description No. 56—Description Heavy chain CDR grafted anti-IL-5; Description No. 57—Description Heavy Chain CDR1; Description No. 58—Description Heavy Chain CDR1, Antibody for paroxysmal nocturnal hemoglobinuria; Description No. 59—Description Heavy chain CDR1, Antibody for rheumatoid arthritis; Description No. 60—Description Heavy Chain CDR1, immunesuppressant; Description No. 61—Description Heavy Chain CDR2; Description No. 62—Description Heavy Chain CDR2, Antibody for paroxysmal nocturnal hernoglobinuria; Description No. 63—Description Heavy chain CDR2, Antibody for rheumatoid arthritis; Description No. 64—Description Heavy Chain CDR2, immunesuppressant; Description No. 65-Description Heavy Chain CDR3; Description No. 66—Description Heavy Chain CDR3. Antibody for paroxysmal nocturnal hemoglobinuria; Description No. 67—Description Heavy chain CDR3, Antibody for rheumatoid arthritis; Description No. 68—Description Heavy Chain CDR3, immunesuppressant; Description No. 69—Description Heavy chain chimeric; Description No. 70—Description Heavy chain Consensus sequence; Description No. 71—Description Heavy chain constant; Description No. 72—Description heavy chain constant domain; Description No. 73—Description Heavy chain constant gamma-1; Description No. 74—Description Heavy chain constant1u gamma 1; Description No. 75—Description Heavy chain constant of polypeptide; Description No. 76—Description Heavy chain-constant region Hu1D10-IgG2M3; Description No. 77—Description Heavy chain constant region, human IgG4; Description No. 78-Description Heavy chain constant region, wildtype; Description No. 79-Description Heavy chain constant, CH1; Description No. 80-Description Heavy chain constant, CH2; Description No. 81-Description Heavy chain constant, CH3; Description No. 82-Description Heavy chain constant, human IgG; Description No. 83—Description Heavy chain constant human IgG4; Description No. 84—Description Heavy chain constant, human IgG4 hingeless; Description No. 85—Description Heavy chain Fab; Description No. 86—Description Heavy chain Fab fragment, Chimeric (anti-alpha2-VH-IGHG1-CH1); Description No. 87—Description Heavy chain gamma consensus sequence; Description No. 88—Description Heavy chain gamma sequence; Description No. 89-Description Heavy chain humanized construct H1; Description No. 90-Description Heavy chain humanized construct H14; Description No. 91-Description Heavy chain humanized construct H15; Description No. 92—Description Heavy chain humanized construct H6; Description No. 93—Description Heavy chain humanized construct H17; Description No. 94-Description Heavy chain humanized construct H18; Description No. 95—Description Heavy chain humanized construct H19; Description No. 96—Description Heavy chain humanized construct H20; Description No. 97—Description Heavy chain humanized construct H21; Description No. 98—Description Heavy chain humanized construct H22; Description No. 99—Description Heavy chain humanized construct H23; Description No. 100—Description Heavy chain humanized construct H24; Description No. 101—Description Heavy chain humanized construct H25; Description No. 102—Description Heavy chain humanized construct H5; Description No. 103—Description Heavy chain humanized construct H6; Description No. 104—Description Heavy chain humanized construct H700; Description No. 105—Description Heavy chain IgG4, immunomodulator; Description No. 106—Description Heavy chain immunoglobulin variable region; Description No. 107—Description Heavy chain immunoglobulin; Description No. 108—Description Heavy chain leader and variable region of the murine anti-IGF-1 receptor antibody; Description No. 109—Description Heavy chain mature; Description No. 110-Description Heavy chain mature fragment; Description No. 111—Description Heavy chain mature immunoglobulin.; Description No. 112 Description Heavy chain mature variable region; Description No. 113—Description Heavy chain mature Antibody for rheumatic diseases; Description No. 114—Description Heavy chain of huAbF46-H4-A1, human IgG2 hinge and constant region of human IgG1; Description No. 115—Description Heavy chain of huAbF46-114-A1, human IgG2 hinge and constant region of human IgG2; Description No. 116—Description Heavy chain of huAbF46-H4-A1, U6-HC7 hinge and constant region of human IgG1; Description No. 117-Description Heavy chain polypeptide; Description No. 118—Description Heavy chain protein; Description No. 119—Description Heavy chain sequence; Description No. 120—Description Heavy chain used in humanization; Description No. 121—Description Heavy chain variable and constant chain; Description No. 122—Description Heavy chain variable domain; Description No. 123—Description heavy chain variable domain H1 AC10; Description No. 124—Description heavy chain variable domain H2 AC11; Description No. 125—Description heavy chain variable domain H3 AC12; Description No. 126—Description heavy chain variable domain L1 AC11; Description No. 127—Description heavy chain variable domain L2 AC12; Description No. 128—Description heavy chain variable domain L3 AC13; Description No. 129—Description Heavy chain variable domain of anti-alpha2-integrin; Description No. 130—Description Heavy chain variable domain of anti-alpha2-integrin mAb; Description No. 131–Description Heavy Chain Variable Domain Antibody for rheumatoid arthritis, psoriatic arthritis, ankylosing spondylitis, Crohn's disease, ulcerative colitis, moderate to severe chronic psoriasis and juvenile idiopathic arthritis, D2E7; Description No. 132—Description Heavy Chain Variable domain, immunesuppressant for lupus; Description No. 133—Description Heavy chain variable domain, murine; Description No. 134—Description Heavy chain variable of scFv, immunesuppressant for lupus; Description No. 135—Description heavy chain variable region (excludes the heavy chain variable region of the ErbB3 binding site of 16F); Description No. 136—Description heavy chain variable region (VH); Description No. 137—Description Heavy chain variable region (with signal sequence removed), Description No. 138—Description Heavy chain variable region 1; Description No. 139-Description Heavy chain variable region 2; Description No. 140—Description heavy chain variable region and heavy chain; Description No. 141—Description Heavy chain variable region and IgG1 constant region; Description No. 142—Description Heavy chain variable region chain, Antibody for rheumatoid arthritis; Description No. 143—Description Heavy chain variable region consensus framework; Description No. 144—Description Heavy chain variable region domain (as translated) listed in U.S. Pat. No. 5,736,137; Description No. 145—Description Heavy chain variable region domain chain 1, Anti-IgE antibody; Description No. 146—Description Heavy chain variable region domain. Antibody for Fibrotic diseases, scarring, diffuse scleroderma; Description No. 147—Description heavy chain variable region dual variable domain; Description No. 148—Description Heavy chain variable region humanized construct H1; Description No. 149—Description Heavy chain variable region humanized construct H14; Description No. 150—Description Heavy chain variable region humanized construct H15; Description No. 151—Description Heavy chain variable region humanized construct H16; Description No. 152—Description Heavy chain variable region humanized construct H17; Description No. 153—Description Heavy chain variable region humanized construct H18; Description No. 154—Description Heavy chain variable region humanized construct H19; Description No. 1.55—Description Heavy chain variable region humanized construct H20; Description No. 156—Description Heavy chain variable region humanized construct H21; Description No. 157—Description Heavy chain variable region humanized construct H22; Description No. 158—Description Heavy chain variable region humanized construct H23; Description No. 159—Description Heavy chain variable region humanized construct H24; Description No. 160—Description Heavy chain variable region humanized construct H25; Description No. 161—Description Heavy chain variable region humanized construct H5; Description No. 162—Description Heavy chain variable region humanized construct H6; Description No. 163—Description Heavy chain variable region humanized construct H700; Description No. 164—Description Heavy chain variable region variant; Description No. 165—Description Heavy chain variable region with CDRs and human CH1-hinge-aglycosylCH2CH3; Description No. 166—Description Heavy chain variable region with predicted signal; Description No. 167—Description Heavy chain variable region without predicted signal; Description No. 168—Description Heavy chain variable region without signal; Description No. 169—Description Heavy chain variable region without signal sequence; Description No. 170—Description Heavy chain variable region, Amino acid sequence encoded by the 4-61 gene; Description No. 171—Description Heavy chain variable region, Antibody for acute coronary syndrome, atherosclerosis; Description No. 172—Description Heavy chain variable region, Antibody for allograft rejection; Description No. 173—Description Heavy Chain Variable Region, Antibody for chronic plaque psoriasis; Description No. 174—Description Heavy chain variable region, Antibody for Neuromyelitis optica and NMO Spectrum Disorder; Description No. 175—Description Heavy chain variable region, Antibody for osteoporosis; Description No. 176—Description Heavy chain variable region, Antibody for psoriasis (blocks T-cell migration); Description No. 177—Description Heavy chain variable region, Antibody for Pulmonary Fibrosis; Description No. 178—Description Heavy chain variable region, Antibody for rheumatoid arthritis; Description No. 179—Description Heavy chain variable region, camelid derived; Description No. 180—Description Heavy chain variable region, chimeric; Description No. 181—Description Heavy chain variable region, E26 variants; Description No. 182—Description Heavy chain variable region, human IgG1 subgroup III; Description No. 183—Description Heavy chain variable region, humanized, immunoglobulin; Description No. 184—Description Heavy Chain Variable Region, immunesuppressant Description No. 185—Description Heavy chain variable region, immunoglobulin; Description No. 186-Description Heavy chain variable region, or mature/immunoglobulin; Description No. 187-Description heavy chain variable region variant; Description No. 188—Description Heavy chain variable region, with peptide signal; Description No. 189—Description Heavy chain variable region-CDR1; Description No. 190—Description Heavy chain variable region-CDR2; Description No. 191—Description Heavy chain variable region-CDR3; Description No. 192—Description Heavy chain variable region-CH1; Description No. 193—Description Heavy chain variable, Antibody for allergic reaction peanuts; Description No. 194—Description Heavy chain variable, Antibody for psoriasis, graft-versus-host disease (prevention), acute kidney transplant rejection; Description No. 195—Description Heavy chain variable, Antibody for rheumatoid arthritis; Description No. 196—Description Heavy chain variable, Antibody for rheumatoid arthritis, lupus nephritis etc, multiple sclerosis; Description No. 197—Description Heavy chain variant; Description No. 198—Description Heavy chain V-D-J assignment; Description No. 199—Description Heavy chain wild-type; Description No. 200—Description Heavy Chain with Flag Tag; Description No. 201—Description Heavy chain with signal peptide; Description No. 202—Description Heavy chain, ANGPT2; Description No. 203—Description Heavy chain, Antibody for acute coronary syndrome atherosclerosis; Description No. 204—Description Heavy chain, Antibody for allergic diseases; Description No. 205—Description Heavy chain, Antibody for allergic disorders; Description No. 206—Description Heavy chain, Antibody for Allograft rejection, intravenous steroid-refractory ulcerative colitis, kidney transplantation, psoriasis; Description No. 207—Description Heavy chain, Antibody for Allograft rejection, graft-versus-host disease; Description No. 208—Description Heavy chain, Antibody for asthma, rheumatoid arthritis, leukemia, inflammatory diseases; Description No. 209—Description Heavy Chain, Antibody for Crohn's disease and rheumatoid arthritis; Description No. 210—Description Heavy chain, Antibody for Crohn's disease, psoriasis, ankylosing spondylitis; Description No. 211—Description Heavy chain, Antibody for Crohn's disease, Psoriasis, Transplantation, Type 1 diabetes, Ulcerative colitis, Multiple sclerosis, Atherosclerosis; Description No. 212—Description Heavy chain, Antibody for diabetes mellitus type 1; Description No. 213—Description Heavy chain, Antibody for diabetes mellitus type 1, psoriasis; Description No. 214—Description Heavy chain, Antibody for diabetes, vascular disease, acne, cancer and psoriasis; Description No. 215—Description Heavy chain, Antibody for Idiopathic pulmonary fibrosis; Description No. 216—Description Heavy chain, Antibody for idiopathic pulmonary fibrosis, focal segmental glomerulosclerosis, cancer; Description No. 217—Description Heavy chain, Antibody for osteoporosis; Description No. 218—Description Heavy chain, Antibody for osteoporosis, Denosumab αOPGL-1; Description No. 219—Description Heavy Chain, Antibody for paroxysmal nocturnal hemoglobinuria; Description No. 220—Description Heavy Chain, Antibody for Plague-type psoriasis; Description No. 221—Description Heavy chain, Antibody for prevention of organ transplant rejections; Description No. 222—Description Heavy chain, Antibody for psoriasis; Description No. 223—Description Heavy chain, Antibody for psoriasis, organ transplant immunological rejection suppression; Description No. 224—Description Heavy chain, Antibody for Psoriasis, rheumatoid arthritis; Description No. 225—Description Heavy chain, Antibody for Psoriasis, rheumatoid arthritis, sciatica, lumbar radicular pain; Description No. 226—Description Heavy chain, Antibody for psoriasis, Crohn's disease, multiple sclerosis; Description No. 227—Description Heavy chain, Antibody for Psoriatic arthritis; Description No. 228—Description Heavy chain, Antibody for rheumatic diseases; Description No. 229—Description Heavy chain, Antibody for rheumatoid arthritis; Description No. 230—Description Heavy chain, Antibody for Rheumatoid arthritis, disease-modifying anti-rheumatic drug; Description No. 231-Description Heavy chain, Antibody for Rheumatoid arthritis, Multiple sclerosis; Description No. 232—Description Heavy Chain, Antibody for rheumatoid arthritis, psoriatic arthritis, ankylosing spondylitis, Crohn's disease, Ulcerative colitis, moderate to severe chronic psoriasis and juvenile idiopathic arthritis, D2E7; Description No. 233—Description Heavy chain, Antibody for Systemic lupus erythematosus; Description No. 234—Description Heavy Chain, Antibody for ulcerative colitis and Crohn's disease; Description No. 235—Description Heavy chain, Anti-EGFr; Description No. 236—Description Heavy chain, anti-IGFR Fab-hLIGHT; Description No. 237—Description Heavy chain chimeric; Description No. 238—Description Heavy chain, fusion; Description No. 239—Description Heavy chain, human subgroup II; Description No. 240—Description Heavy chain, immunoglobulin; Description No. 241—Description Heavy Chain, immunosuppressant; Description No. 242—Description Heavy chain, immunosuppressive drug; Description No. 243—Description Heavy chain, *Mus musculus*; Description No. 244—Description Heavy chain, VEGFA; Description No. 245—Description Heavy Chain-constant and variable region; Description No. 246—Description Heavy chain-constant region; Description No. 247—Description Heavy chain-constant region of Hu1D10-IgG1; Description No, 248—Description Heavy chain-variable region; Description No. 249—Description Heavy chain-variable region of Hu1d10-IgG2M3 or Hu1D10-IgG1; Description No. 250—Description Heavy CHIMERIC chain 1 immunesuppressant, Anti-CD25 antibody; Description No. 251—Description Heavy-chain-CDR1; Description No. 252—Description Heavy-chain-CDR2; Description No. 253—Description Heavy-chain-CDR3; Description No. 254—Description Herceptin Heavy chain variable region-CH1 (Heavy chain variable region(1-120)+CH1(121-218)); Description No. 255—Description H-GAMMA-1 (Heavy chain variable region(1-118)+CH1(119-216)+HINGE-REGION(217-231)+CH2(232-341)+CH3(342-448)); Description No. 256—Description H-GAMMA-1 (Heavy chain variable region(1-120)+CH1(121-218)+HINGE-REGION(219-233)+CH2(234-343)+CH3(344-450); Description No. 257—Description H-GAMMA-1 (Heavy chain variable region(1-121)+CH1(122-219)+HINGE-REGION(220-220)+CH2(221-330)+CH3(331-437), Description No. 258—Description Hinge, CH2 and CH3 domain of IgG1; Description No. 259—Description huHMFG1-scFv; Description No. 260—Description HuLuc-63 Heavy chain variable CDR1; Description No. 261—Description HuLuc-63 Heavy Chain variable CDR2, Description No. 262-Description HuLuc-63 Heavy chain variable CDR3; Description No. 263—Description HuLuc-63 Light chain variable CDR1; Description No. 264—Description HuLuc-63 Light chain variable CDR2; Description No. 265—Description HuLuc-63 Light chain variable CDR3; Description No. 266-Description human Heavy chain—constant region, Description No. 267—Description Human IgG2 hinge region; Description No. 268—Description Humanized Heavy chain variable region-CH1 (Heavy chain variable region(1-121)+CH1(122-219)); Description No. 269-Description Humanized Heavy chain variable region-CH1(Heavy chain variable region(1-121)+CH1(122-201); Description No. 270—Description Humanized Light chain-KAPPA (V-KAPPA(1-107)+C-KAPPA (1.08-211)); Description No. 271—Description Humanized Light chain-KAPPA (V-KAPPA(1-107)+C-KAPPA(108-214)); Description No. 272-Description Humanized L-KAPPA; Description No. 273—Description Human-mouse chimeric anti-CD20 Heavy chain 1; Description No. 274—Description Human-mouse chimeric anti-CD20 Light chain 1; Description No. 275—Description Ig gamma-1 chain C region; Description No. 276—Description Ig kappa constant region; Description No. 277—Description IGHG1 constant region; Description No. 278—Description immunosuppressive drug; Description No. 279—Description isoleucine zipper; Description No. 280—Description Kappa constant region; Description No. 281—Description kappa light chain; Description No. 282—Description Kappa Light Chain—variable region; Description No. 283—Description Lambda light chain; Description No. 284—Description Light chain; Description No. 285—Description Light Chain—variable region; Description No. 286—Description Light Chain (Genetic Recombination), Antibody for paroxysmal nocturnal hemoglobinuria; Description No. 287—Description Light chain (h-KAPPA (V-KAPPA(1-107)+C-KAPPA(108-214)); Description No. 288—Description Light chain 1; Description No. 289—Description Light Chain 1, Antibody for immunesuppressant; Description No. 290—Description Light chain 1, Anti-HER2; Description No. 291—Description Light chain 2; Description No. 292—Description Light chain 3; Description No. 293—Description Light chain 4; Description No. 294—Description Light chain amino acid sequence humanized; Description No. 295-Description Light chain and lambda constant region; Description No. 296-Description Light chain antigen binding region; Description No. 297—Description Light chain CDR; Description No. 298—Description Light Chain CDR 1, immunesuppressant; Description No. 299—Description Light Chain CDR 2, immunesuppressant; Description No. 300—Description Light Chain CDR 3, immunesuppressant; Description No. 301—Description Light chain CDR grafted anti-IL-5; Description No. 302—Description Light chain CDR1; Description No. 303—Description Light Chain CDR1, Antibody for paroxysmal nocturnal hernoglobinuria; Description No. 304—Description Light chain CDR1, Antibody for rheumatoid arthritis; Description No. 305-Description Light Chain CDR1, immunesuppressant; Description No. 306—Description Light chain CDR2; Description No. 307-Description Light Chain CDR2, Antibody for paroxysmal nocturnal hemoglobinuria; Description No. 308—Description Light chain CDR2, Antibody for rheumatoid arthritis; Description No. 309—Description Light Chain CDR2, immunesuppressant; Description No. 310-Description Light chain CDR3; Description No. 311—Description Light Chain CDR3, Antibody for paroxysmal nocturnal hemoglobinuria; Description No. 312—Description Light chain CDR3, Antibody for rheumatoid arthritis; Description No. 313—Description Light Chain CDR3, immunesuppressant; Description No. 314—Description Light chain chimeric; Description No. 315—Description Light chain Ck; Description No. 316—Description Light chain consensus, bum κ1, light kappa subgroup I; Description No. 317—Description Light chain constant region; Description No. 318-Description Light chain constant region kappa; Description No. 319—Description Light chain constant region of Hu1D10-IgG2M3 or Hu1D10-IgG1; Description No. 320—Description Light chain constant region, kappa; Description No. 321—Description Light chain constant region, lambda, human; Description No. 322—Description Light chain D; Description No. 323—Description Light Chain F; Description No. 324—Description Light chain F; Description No. 325—Description Light chain humanized construct L11; Description No. 326—Description Light chain humanized construct L13; Description No. 327—Description Light chain humanized construct L14; Description No. 328—Description Light chain humanized construct L15; Description No. 329—Description Light chain humanized construct L16; Description No. 330—Description Light chain humanized construct L17; Description No. 331—Description Light chain humanized construct L18; Description No. 332—Description Light chain humanized construct L6; Description No. 333—Description Light chain IgG4, immunomodulator; Description No. 334—Description Light chain immunoglobulin variable region; Description No. 335—Description Light chain immunoglobulin; Description No. 336—Description Light chain kappa; Description No. 337—Description Light chain Kappa, Antibody for allergic reaction peanuts; Description No. 338—Description Light chain kappa consensus framework, human; Description No. 339—Description Light chain kappa consensus sequence; Description No. 340—Description Light chain kappa constant; Description No. 341—Description Light chain kappa constant region; Description No. 342—Description Light chain kappa sequence; Description No. 343—Description Light chain kappa variable region; Description No. 344—Description Light chain leader and variable region of the murine anti-IGF-I receptor antibody, Description No. 345—Description Light chain mature; Description No. 346—Description Light chain mature fragment; Description No. 347—Description Light chain mature immunoglobulin; Description No. 348—Description Light chain mature protein, Antibody for rheumatic diseases; Description No. 349—Description Light chain mature variable region; Description No. 350—Description Light chain huAbF46-H4-A1(H36Y) and human kappa constant region; Description No. 351—Description Light chain polypeptide; Description No. 352—Description Light chain protein; Description No. 353—Description Light chain sequence; Description No. 354—Description Light Chain used in humanization; Description No. 355—Description Light chain variable and constant chain; Description No. 356—Description Light chain variable domain of anti-alpha2-integrin; Description No. 357—Description Light chain variable domain of anti-alpha2-integrin mAb; Description No. 358—Description Light Chain Variable Domain, Antibody for rheumatoid arthritis, psoriatic arthritis, ankylosing spondylitis, Crohn's disease, ulcerative colitis, moderate to severe chronic psoriasis and juvenile idiopathic arthritis, D2E7; Description No. 359—Description Light chain variable domain, immunosuppressant for lupus; Description No. 360—Description Light chain variable kappa.; Description No. 361—Description Light chain variable kappa, Amino acid sequence encoded by the VK gene; Description No. 362—Description Light chain variable of scFv, immunesuppressant for lupus; Description No. 363—Description Light chainvariable region; Description No. 364—Description Light chain variable region; Description No. 365—Description light chain variable region (excludes the light chain variable region sequence of the ErbB3 binding site of 16F); Description No. 366—Description light chain variable region (excludes the light chain variable region sequence of the IGF-1R binding site of 16F); Description No. 367—Description light chain variable region (VL); Description No. 368—Description light chain variable region 1; Description No. 369—Description Light chain variable region 2; Description No. 370—Description Light chain variable region and human IgG1 constant region; Description No. 371—Description light chain variable region and light chain; Description No. 372—Description Light chain variable region consensus framework; Description No. 373—Description Light chain variable region domain (as translated) listed in U.S. Pat. No. 5,736,137; Description No. 374—Description Light chain variable region domain chain 1, Anti-IgE antibody; Description No. 375—Description Light chain variable region domain listed in U.S. Pat. No. 5,736,137 (with signal sequence removed); Description No. 376—Description Light chain variable region domain, Antibody for Fibrotic diseases, scarring, diffuse scleroderma; Description No. 377—Description light chain variable region dual variable domain; Description No. 378—Description Light chain variable region humanized construct L11; Description No. 379—Description Light chain variable region humanized construct L13; Description No. 380—Description Light chain variable region humanized construct L14; Description No. 381—Description Light chain variable region humanized construct L15; Description No. 382—Description Light chain variable region humanized construct L16; Description No. 383—Description Light chain variable region humanized construct L17; Description No. 384—Description Light chain variable region humanized construct L18; Description No. 385—Description Light chain variable region humanized construct L6; Description No. 386—Description Light chain variable region kappa; Description No. 387—Description Light chain variable region of Hu1D10-IgG2M3 or Hu1D10-IgG1; Description No. 388—Description Light chain variable region variant; Description No. 389—Description Light chain variable region with predicted signal; Description No. 390—Description Light chain variable region without predicted signal; Description No. 391—Description Light chain variable region without signal sequence; Description No. 392—Description Light chain variable region, Antibody for acute coronary syndrome, atherosclerosis; Description No. 393—Description Light chain variable region, Antibody for allograft rejection; Description No. 394—Description Light Chain Variable Region, Antibody for chronic plaque psoriasis; Description No. 395—Description Light chain variable region, Antibody for idiopathic pulmonary fibrosis, focal segmental glomerulosclerosis, cancer; Description No. 396—Description Light chain variable region, Antibody for Neuromyelitis optica and NMO Spectrum Disorder; Description No. 397—Description Light Chain Variable Region, Antibody for osteoporosis; Description No. 398—Description Light chain variable region, Antibody for psoriasis (blocks T-cell migration); Description No. 399—Description Light chain variable region, Antibody for Pulmonary Fibrosis; Description No. 400—Description Light chain variable region, Antibody for rheumatoid arthritis; Description No. 401—Description Light chain variable region, camelid derived; Description No. 402—Description Light chain variable region, chimeric; Description No. 403—Description Light chain variable region, Chimeric antigen receptor with cd19Binding domain; Description No. 404—Description Light chain variable region, E26 variants; Description No. 405—Description light chain variable region, Human kappa; Description No. 406—Description Light chain variable region, humanized; Description No. 407—Description Light chain variable region, humanized, immunoglobulin; Description No. 408—Description Light Chain Variable Region, immunesuppressant; Description No. 409—Description Light chain variable region, immunoglobulin; Description No. 410—Description Light chain variable region, or mature/immunoglobulin; Description No. 411—Description light chain variable region, variant; Description No. 412—Description Light chain variable region; Light chain C; Description No. 413—Description Light chain variable region; Light chain D; Description No. 414—Description Light chain variable region; Light chain F; Description No. 415—Description Light chain variable region; Light chain F; Description No. 416—Description Light chain variable region-CDR1 From U.S. Pat. No. 8,557,243; Description No. 417—Description Light chain variable region-CDR2 From U.S. Pat. No. 8,557,243, Description No. 418—Description Light chain variable region-CDR3 From U.S. Pat. No. 8,557,243; Description No. 419—Description Light chain variable, Antibody for psoriasis, graft-versus-host disease (prevention), acute kidney transplant rejection; Description No. 420—Description Light chain variable, Antibody for rheumatoid arthritis; Description No. 421—Description Light chain variable, Antibody for rheumatoid arthritis, lupus nephritis etc, multiple sclerosis; Description No. 422—Description Light chain variant; Description No. 423—Description Light chain V-J assignment; Description No. 424—Description Light chain wild-type; Description No. 425—Description Light chain with signal peptide; Description No. 426—Description Light chain, 71F10Fab-hLIGHT fusion; Description No. 427-Description Light chain, ANGPT2; Description No. 428—Description Light chain, Antibody for acute coronary syndrome, atherosclerosis; Description No. 429—Description Light chain, Antibody for allergic diseases; Description No. 430—Description Light chain, Antibody for allergic disorders; Description No. 431—Description Light chain, Antibody for Allograft rejection intravenous steroid-refractory ulcerative colitis, kidney transplantation, psoriasis; Description No. 432—Description Light chain, Antibody for Allograft rejection, graft-versus-host disease; Description No. 433—Description Tight chain, Antibody for asthma, rheumatoid arthritis, leukemia, inflammatory diseases; Description No. 434—Description Light Chain. Antibody for Crohn's disease and rheumatoid arthritis; Description No. 435—Description Light chain, Antibody for Crohn's disease, psoriasis, ankylosing spondylitis; Description No. 436—Description Light chain, Antibody for Crohn's disease, Psoriasis, Transplantation, Type 1 diabetes, Ulcerative colitis, Multiple sclerosis, Atherosclerosis; Description No. 437—Description Light chain, Antibody for diabetes mellitus type 1, psoriasis; Description No. 438—Description Light chain, Antibody for diabetes mellitus type 2; Description No. 439—Description Light chain, Antibody for diabetes, vascular disease, acne, cancer and psoriasis; Description No. 440—Description Light chain, Antibody for idiopathic pulmonary fibrosis; Description No. 441—Description Light chain, Antibody for idiopathic pulmonary fibrosis, focal segmental glomerulosclerosis, cancer; Description No. 442—Description Light chain, Antibody for osteoporosis; Description No. 443—Description Light chain, Antibody for osteoporosis, Denosumab αOPGL-1; Description No. 444—Description Light Chain, Antibody for paroxysmal nocturnal hemoglobinuria; Description No. 445—Description Light Chain, Antibody for Plaque-type psoriasis; Description No. 446—Description Tight chain, Antibody for prevention of organ transplant rejections; Description No. 447—Description Light chain, Antibody for psoriasis; Description No. 448—Description Light chain, Antibody for psoriasis, organ transplant immunological rejection suppression; Description No. 449—Description Light chain, Antibody for Psoriasis, rheumatoid arthritis; Description No. 450—Description Light chain, Antibody for Psoriatic arthritis; Description No. 451—Description Light chain, Antibody for rheumatic diseases; Description No. 452—Description Light chain, Antibody for rheumatoid arthritis; Description No. 453—Description Light chain, Antibody for Rheumatoid arthritis, disease-modifying anti-rheumatic drug; Description No. 454—Description Light chain, Antibody for Rheumatoid arthritis, Multiple sclerosis; Description No. 455—Description Light chain, Antibody for rheumatoid arthritis, psoriatic arthritis, ankylosing spondylitis. Crohn's disease, ulcerative colitis, moderate to severe chronic psoriasis and juvenile idiopathic arthritis, D2E7; Description No. 456—Description Light chain, Antibody for Systemic lupus erythematosus; Description No. 457—Description Light Chain, Antibody for ulcerative colitis and Crohn's disease; Description No. 458—Description Light chain, anti-CD23 Fab-hLIGHT fusion; Description No. 459—Description Light chain, chimeric; Description No. 460—Description Light chain, Chimeric (anti-alpha2-VL-IGKC-CL); Description No. 461—Description Light chain, human subgroup; Description No. 462—Description Light Chain, immunesuppressant; Description No. 463—Description Light chain, immunosuppressive drug; Description No. 464—Description Light chain, kappa constant; Lambda chain constant region; Description No. 465—Description Light chain, lambda constant; Description No. 466—Description Tight chain, lambda human Ig; Description No. 467—Description Light chain, *Mus musculus*; Description No. 468—Description Light chain, VEGFA; Description No. 469—Description Licilit chain-variable region; Description No. 470—Description Light CHIMERIC chain 1, immunesuppressant, Anti-CD25 antibody; Description No. 471—Description L-KAPPA (V-KAPPA(1-107)+C-KAPPA(108-214)); Description No. 472—Description MAb17-1A gamma; Description No. 473-Description MAb17-1A kappa; Description No. 474—Description Mouse Anti-CD20 Heavy chain; Description No. 475—Description Mouse Anti-CD20 Light chain; Description No. 476—Description Nanobody; Description No. 477—Description Polypeptide; Description No. 478—Description polypeptide, Antibody for thrombotic thrombocytopenic purpura, acute coronary syndrome; Description No. 479—Description Scf Light chain variable region-Heavy; Description No. 480—Description ScFv; Description No. 481—Description say fusion protein; Description No. 482—Description Scfv Heavy-Light; Description No. 483—Description say immunesuppressant for lupus; Description No. 484—Description say, Antibody for allergic reaction peanuts; Description No. 485—Description ScFv, BHA10 ScFvs with S46(VL) stabilizing mutation; Description No. 486—Description Scfv, BHA10 Says with V55G(VL) stabilizing mutation; Description No. 487—Description Scfv, Chimeric antigen receptor with cd19Binding domain; Description No. 488—Description scFv-CH chain; Description No. 489—Description SEA/E-120; Description No. 490—Description secretory signal sequence of Heavy chain; Description No. 491—Description Single chain; Description No. 492—Description Single chain antibody; Description No. 493—Description Single chain scFv; Description No. 494—Description single chain variable fragment; Description No. 495—Description single chain variable fragment (scFv); Description No. 496—Description single chain variable region; Description No. 497—Description Single heavy chain variable domain; Description No. 498—Description. Single variable domain antibody; Description No. 499—Description Single-chain fusion peptide; Description No. 500—Description single-domain; Description No. 501—Description single-domain antibody (dAb); Description No. 502—Description single-domain antibody (sdAb); Description No. 503—Description Small modular immunopharmaceutical (smip) polypeptide; Description No. 504—Description Variable domain antibody; Description No. 505—Description Variable region, Description No. 506—Description variant Fc region; Description No. 507—Description VH-VL; and Description No. 508—Description VL-VH.

In one embodiment, the payload region of the AAV particle comprises one or more nucleic acid sequences encoding Priliximab, a fragment or variant thereof. As a non-limiting example, the payload region of the AAV particle comprises one or more nucleic acid sequences encoding Priliximab may be used to treat, prevent and/or reduce the effects of multiple sclerosis. As another non-limiting example, the payload region of the AAV particle comprises one or more nucleic acid sequences encoding Priliximab, a fragment or variant thereof may be used to treat, prevent and/or reduce the effects of Crohns Disease.

In one embodiment, the payload region of the AAV particle comprises one or more nucleic acid sequences encoding Rovelizumab, a fragment or variant thereof. As a non-limiting example, the payload region of the AAV particle comprises one or more nucleic acid sequences encoding Rovelizumab, a fragment or variant thereof may be used to treat, prevent and/or reduce the effects of multiple sclerosis.

In one embodiment, the payload region of the AAV particle comprises one or more nucleic acid sequences encoding Nerelimomab, a fragment or variant thereof. As a non-limiting example, the payload region of the AAV particle comprises one or more nucleic acid sequences encoding Nerelimomab, a fragment or variant thereof may be used as an immunosuppressant.

In one embodiment, the payload region of the AAV particle comprises one or more nucleic acid sequences encoding BAYX1351, a fragment or variant thereof. As a non-limiting example, the payload region of the AAV particle comprises one or more nucleic acid sequences encoding BAYX1351, a fragment or variant thereof may be used as an immunosuppressant.

In one embodiment, the payload region of the AAV particle comprises one or more nucleic acid sequences encoding Clenoliximab (also known as CE9γ4PE, IDEC-151 and PRIMATIZED®), a fragment or variant thereof. As a non-limiting example, the payload region of the AAV particle comprises one or more nucleic, acid sequences encoding Clenoliximab (also known as CE9γ4PE, IDEC-151 and PRIMATIZED®), a fragment or variant thereof may be used to treat, prevent or reduce the effects of rheumatoid arthritis and/or asthma. As a non-limiting example, the payload region of the AAV particle comprises one or more nucleic acid sequences encoding the heavy chain of Clenoliximab (also known as CE9γ4PE, IDE C-151 and PRIMATIZED®), a fragment or variant thereof may be used to treat, prevent or reduce the effects of rheumatoid arthritis and/or asthma. As a non-limiting example, the payload region of the AAV particle comprises one or more nucleic acid sequences encoding the light chain of Clenoliximab (also known as CE9γ4PE, IDEC-151 and PRIMATIZED®), a fragment or variant thereof may be used to treat, prevent or reduce the effects of rheumatoid arthritis and/or asthma. As a non-limiting, example, the payload region of the AAV particle comprises one or more nucleic acid sequences encoding the heavy chain of Clenoliximab (also known as CE9γ4PE, IDEC-151 and PRIMATIZED®) as described in U.S. Pat. No. 6,136,310 as SEQ ID NO: 11 (the contents of which are herein incorporated by reference in its entirety), a fragment or variant thereof may be used to treat, prevent or reduce the effects of rheumatoid arthritis and/or asthma. As a non-limiting example, the payload region of the AA V particle comprises one or more nucleic acid sequences encoding the light chain of Clenoliximab (also known as CE9γ4PE, IDEC-151 and PRIMATIZED®) as described in U.S. Pat. No. 6,136,310 as SEQ ID NO: 5 (the contents of which are herein incorporated by reference in its entirety), a fragment or variant thereof may be used to treat, prevent or reduce the effects of rheumatoid arthritis and/or asthma.

In one embodiment, the payload region of the AAV particle comprises one or more nucleic acid sequences encoding Maslimoniab, a fragment or variant thereof. As a non-limiting example, the payload region of the AAV particle comprises one or more nucleic acid sequences encoding Maslimomab, a fragment or variant thereof may be used as an immunosuppressant.

In one embodiment, the payload region of the AAV particle comprises one or more nucleic acid sequences encoding Atorolimumab (also known as P3x22914G4), a fragment or variant thereof. As a non-limiting example, the payload region of the AAV particle comprises one or more nucleic acid sequences encoding Atorolimumab (also known as P3x22914G4), a fragment or variant thereof may be used as an immunosuppressant.

In one embodiment, the payload region of the AAV particle comprises one or more nucleic acid sequences encoding Vapaliximab (also known as 2D10), a fragment or variant thereof. As a non-limiting example, the payload region of the AAV particle comprises one or more nucleic acid sequences encoding Vapaliximab (also known as 2D10), a fragment or variant thereof may be used as an immunosuppressant.

In one embodiment, the payload region of the AAV particle comprises one or more nucleic acid sequences encoding Ziralimumab (also known as ABX-RB2, cem2.6), a fragment or variant thereof. As a non-limiting example, the payload region of the AAV particle comprises one or more nucleic acid sequences encoding Ziralimumab (also known as ABX-RB2, cem2.6), a fragment or variant thereof may be used to treat, prevent and/or reduce the effects of cancer, inflammation and/or immune system disorders.

In one embodiment, the payload region of the AAV particle comprises one or more nucleic acid sequences encoding Zolimomab aritox (also known as H65-ricin A chain immunotoxin and H65-RTA), a fragment or variant thereof. As a non-limiting example, the payload region of the AAV particle comprises one or more nucleic acid sequences encoding Zolimomab aritox (also known as H65-ricin A chain immunotoxin and H65-RTA) a fragment or variant thereof may be used to treat, prevent or reduce the effects of systemic lupus erythematosus, graft-versus-host disease and/or cutaneous T cell lymphoma.

In one embodiment, the payload region of the AAV particle comprises one or more nucleic acid sequences encoding Zanolimuniab (also known as HuMax-CD4), a fragment or variant thereof. As a non-limiting example, the payload region of the AAV particle comprises one or more nucleic acid sequences encoding Zanolimumab also known as Hu Max-CD4), fragment or variant thereof may be used to treat, prevent or reduce the effects of rheumatoid arthritis, psoriasis and/or T-cell lymphoma.

In one embodiment, the payload region of the AAV particle comprises one or more nucleic acid sequences encoding Bertilimumab (also known as CAT-213), a fragment or variant thereof. As a non-limiting example, the payload region of the AAV particle comprises one or more nucleic acid sequences encoding Bertilimumab (also known as CAT-213), a fragment or variant thereof may be used to treat, prevent or reduce the effects of allergies.

In one embodiment, the payload region of the AAV particle comprises one or more nucleic acid sequences encoding Pascolizumab (also known as SB 240683), a fragment or variant thereof. As a non-limiting example, the payload region of the AAV particle comprises one or more nucleic acid sequences encoding Pascolizumab (also known as SB-240683), a fragment or variant thereof may be used to treat, prevent or reduce the effects of allergies.

In one embodiment, the payload region of the AAV particle comprises one or more nucleic acid sequences encoding Odulimomab (also known as afolimomab, anti-LFA1 and ANTILFA), a fragment or variant thereof. As a non-limiting example, the payload region of the AAV particle comprises one or more nucleic acid sequences encoding Odulimomab (also known as afolimomab, anti-LFA1 and ANTILFA), a fragment or variant thereof may be used to treat, prevent or reduce the effects of allograft rejection.

In one embodiment, the payload region of the AAV particle comprises one or more nucleic acid sequences encoding Enlimomab pegol, a fragment or variant thereof. As a non-limiting example, the payload region of the AAV particle comprises one or more nucleic acid sequences encoding Enlimomab pegol, a fragment or variant thereof may be used to treat, prevent or reduce the effects of renal transplant rejection.

In one embodiment, the payload region of the AAV particle comprises a nucleic acid sequence encoding an antibody or a fragment thereof as described in United States Publication Nos. US20130122003, US20150056211, US20160069US20150056211, US20160069894 or U.S. Pat. No. 7,524,496. In a non-limiting example, the antibody targets IL-6. In another non-limiting example, the antibody targets EGF.

Migraine and Pain Antibodies

In one embodiment, the payload region of the AAV particle comprises one or more nucleic acid sequences encoding one or more of the migraine and pain payload antibody polypeptides listed in Table 10 (M1-MP564; SEQ ID NO: 3453-3459, 3856, 3890-3898, 4232-4237, 5220-5239, 6406-6429, 6454-6639, 6955-6956, 7905, 8797-8821, 8842-9026, 9288, 17659-17755).

TABLE 10

Migraine and Pain Antibodies

| Antibody No. | Target | Description | Antibody Name | Reference Information | SEQ ID NO |
|---|---|---|---|---|---|
| MP1 | CGRP | Heavy chain | G1, cluster headache | U.S. Pat. No. 9,115,194 SEQ ID NO: 11 | 17659 |
| MP2 | CGRP | Heavy chain | 10E4 | U.S. Pat. No. 9,102,731 SEQ ID NO: 36 | 17660 |
| MP3 | CGRP | Heavy chain | 11H9 | U.S. Pat. No. 9,102,731 SEQ ID NO: 38 | 17661 |
| MP4 | CGRP | Heavy chain | 12G8 HIL | U.S. Pat. No. 9,102,731 SEQ ID NO: 39 | 17662 |
| MP5 | CGRP | Heavy chain | 13H2 | U.S. Pat. No. 9,102,731 SEQ ID NO: 40 | 17663 |
| MP6 | CGRP | Heavy chain | 32H7 | U.S. Pat. No. 9,102,731 SEQ ID NO: 41 | 17664 |
| MP7 | CGRP | Heavy chain | A | US20120294802 SEQ ID NO: 3 | 17665 |
| MP8 | CGRP | Heavy chain | Ab1 | US20120294802 SEQ ID NO: 4 | 17666 |
| MP9 | CGRP | Heavy chain | Ab10 | US20120294802 SEQ ID NO: 94 | 17667 |
| MP10 | CGRP | Heavy chain | Ab11 | US20120294802 SEQ ID NO: 104 | 17668 |
| MP11 | CGRP | Heavy chain | Ab12 | US20120294802 SEQ ID NO: 114 | 17669 |

TABLE 10-continued

Migraine and Pain Antibodies

| Antibody No. | Target | Description | Antibody Name | Reference Information | SEQ ID NO |
|---|---|---|---|---|---|
| MP12 | CGRP | Heavy chain | Ab13 | US20120294802 SEQ ID NO: 124 | 17670 |
| MP13 | CGRP | Heavy chain | 02E7 | U.S. Pat. No. 9,102,731 SEQ ID NO: 31 | 17671 |
| MP14 | CGRP | Heavy chain | Ab14 | US20120294802 SEQ ID NO: 134 | 17672 |
| MP15 | CGRP | Heavy chain | Ab2 | US20120294802 SEQ ID NO: 14 | 17673 |
| MP16 | CGRP | Heavy chain | Ab3 | US20120294802 SEQ ID NO: 24 | 17674 |
| MP17 | CGRP | Heavy chain | Ab4 | US20120294802 SEQ ID NO: 34 | 17675 |
| MP18 | CGRP | Heavy chain | Ab5 | US20120294802 SEQ ID NO: 44 | 17676 |
| MP19 | CGRP | Heavy chain | Ab6 | US20120294802 SEQ ID NO: 54 | 17677 |
| MP20 | CGRP | Heavy chain | Ab7 | US20120294802 SEQ ID NO: 64 | 17678 |
| MP21 | CGRP | Heavy chain | Ab8 | US20120294802 SEQ ID NO: 74 | 17679 |
| MP22 | CGRP | Heavy chain | Ab9 | US20120294802 SEQ ID NO: 84 | 17680 |
| MP23 | CGRP | Heavy chain | B | US20120294802 SEQ ID NO: 13 | 17681 |
| MP24 | CGRP | Heavy chain | 01E11/04E4/09D4 | U.S. Pat. No. 9,102,731 SEQ ID NO: 29 | 17682 |
| MP25 | CGRP | Heavy chain | C | US20120294802 SEQ ID NO: 23 | 17683 |
| MP26 | CGRP | Heavy chain | D | US20120294802 SEQ ID NO: 33 | 17684 |
| MP27 | CGRP | Heavy chain | E | US20120294802 SEQ ID NO: 43 | 17685 |
| MP28 | CGRP | Heavy chain | F | US20120294802 SEQ ID NO: 53 | 17686 |
| MP29 | CGRP | Heavy chain | G | US20120294802 SEQ ID NO: 63 | 17687 |
| MP30 | CGRP | Heavy chain | H | US20120294802 SEQ ID NO: 73 | 17688 |
| MP31 | CGRP | Heavy chain | I | US20120294802 SEQ ID NO: 83 | 17689 |
| MP32 | CGRP | Heavy chain | J | US20120294802 SEQ ID NO: 93 | 17690 |
| MP33 | CGRP | Heavy chain | K | US20120294802 SEQ ID NO: 103 | 17691 |
| MP34 | CGRP | Heavy chain | L | US20120294802 SEQ ID NO: 113 | 17692 |
| MP35 | CGRP | Heavy chain | 01H7 | U.S. Pat. No. 9,102,731 SEQ ID NO: 30 | 17693 |
| MP36 | CGRP | Heavy chain | M | US20120294802 SEQ ID NO: 123 | 17694 |
| MP37 | CGRP | Heavy chain | N | US20120294802 SEQ ID NO: 133 | 17695 |
| MP38 | CGRP | Heavy chain | 03B6 | U.S. Pat. No. 9,102,731 SEQ ID NO: 32 | 17696 |
| MP39 | CGRP | Heavy chain | 03C8/05F5/12E8 | U.S. Pat. No. 9,102,731 SEQ ID NO: 33 | 17697 |
| MP40 | CGRP | Heavy chain | 04H6 | U.S. Pat. No. 9,102,731 SEQ ID NO: 34 | 17698 |
| MP41 | CGRP | Heavy chain | 09F5 | U.S. Pat. No. 9,102,731 SEQ ID NO: 35 | 17699 |
| MP42 | CGRP | Heavy chain | 11D11 | U.S. Pat. No. 9,102,731 SEQ ID NO: 37 | 17700 |
| MP43 | TrkA | Heavy chain | BXhVH1 | WO2009098238 SEQ ID NO: 1 | 3453 |
| MP44 | TrkA | Heavy chain | BXhVH2 | WO2009098238 SEQ ID NO: 2 | 3455 |
| MP45 | TrkA | Heavy chain | BXhVH3 | WO2009098238 SEQ ID NO: 3 | 3456 |
| MP46 | TrkA | Heavy chain | BXhVH4 | WO2009098238 SEQ ID NO: 4 | 3457 |
| MP47 | TrkA | Heavy chain | BXhVH5 | WO2009098238 SEQ ID NO: 5 | 3458 |
| MP48 | TrkA | Heavy chain | BXhVH5VL1 | US20150183885 SEQ ID NO: 28 | 5220 |

TABLE 10-continued

Migraine and Pain Antibodies

| Antibody No. | Target | Description | Antibody Name | Reference Information | SEQ ID NO |
|---|---|---|---|---|---|
| MP49 | TrkA | Heavy chain | GBR VH5(G42E)VL1 | US20150183885 SEQ ID NO: 53 | 5224 |
| MP50 | TrkA | Heavy chain | GBR VH5(K3Q)VL1 | US20150183885 SEQ ID NO: 50 | 5221 |
| MP51 | TrkA | Heavy chain | GBR VH5(K3Q, A49S, Y50A)VL1 | US20150183885 SEQ ID NO: 61 | 5232 |
| MP52 | TrkA | Heavy chain | GBR VH5(K3Q, A49S, Y50A, P60A, T62S)VL1 | US20150183885 SEQ ID NO: 66 | 5237 |
| MP53 | TrkA | Heavy chain | GBR VH5(K3Q, P60A, T62S)VL1 | US20150183885 SEQ ID NO: 62 | 5233 |
| MP54 | TrkA | Heavy chain | GBR VH5(K3Q, T40A)VL1 | US20150183885 SEQ ID NO: 58 | 5229 |
| MP55 | TrkA | Heavy chain | GBR VH5(K3Q, T40A, P60A, T62S)VL1 | US20150183885 SEQ ID NO: 63 | 5234 |
| MP56 | TrkA | Heavy chain | GBR VH5(K3Q, T40A, R44G, A49S, Y50A, P60A, T62S)VL1 | US20150183885 SEQ ID NO: 67 | 5238 |
| MP57 | TrkA | Heavy chain | GBR VH5(K3Q, T40A, R44G, A49S, Y50A, P60A, T62S, R94K)VL1 | US20150183885 SEQ ID NO: 68 | 5239 |
| MP58 | TrkA | Heavy chain | GBR VH5(K3Q, T40A, R44G, A49S, Y50A)VL1 | US20150183885 SEQ ID NO: 65 | 5236 |
| MP59 | TrkA | Heavy chain | GBR VH5(K3Q, V37A(VL1 | US20150183885 SEQ ID NO: 56 | 5227 |
| MP60 | TrkA | Heavy chain | GBR VH5(K3Q, V37A)VL1(*) | US20150183885 SEQ ID NO: 57 | 5228 |
| MP61 | TrkA | Heavy chain | GBR VH5(K3Q, V37A, R44G)VL1 | US20150183885 SEQ ID NO: 60 | 5231 |
| MP62 | TrkA | Heavy chain | GBR VH5(K3Q, V37A, T40A, P60A, T62S)VL1 | US20150183885 SEQ ID NO: 64 | 5235 |
| MP63 | TrkA | Heavy chain | GBR VH5(P60A, T62S)VL1 | US20150183885 SEQ ID NO: 59 | 5230 |
| MP64 | TrkA | Heavy chain | GBR VH5(R94K)VL1 | US20150183885 SEQ ID NO: 55 | 5226 |
| MP65 | TrkA | Heavy chain | GBR VH5(V37A)VL1 | US20150183885 SEQ ID NO: 51 | 5222 |
| MP66 | TrkA | Heavy chain | GBR VH5(V37A)VL1(*) | US20150183885 SEQ ID NO: 52 | 5223 |
| MP67 | TrkA | Heavy chain | GBR VH5(V89L)VL1 | US20150183885 SEQ ID NO: 54 | 5225 |
| MP68 | TrkA | Heavy chain | HUVHWOV | WO2009098238 SEQ ID NO: 6 | 3459 |
| MP69 | TrkA | Heavy chain | mVHEP | WO2009098238 SEQ ID NO: 15 | 3454 |
| MP70 | GFRα3 | Heavy chain variable region | H1M2236N | U.S. Pat. No. 8,968,736 SEQ ID NO: 397 | 6425 |
| MP71 | GFRα3 | Heavy chain variable region | H1M2243N | U.S. Pat. No. 8,968,736 SEQ ID NO: 381 | 6424 |

TABLE 10-continued

Migraine and Pain Antibodies

| Antibody No. | Target | Description | Antibody Name | Reference Information | SEQ ID NO |
|---|---|---|---|---|---|
| MP72 | GFRα3 | Heavy chain variable region | H4H2207N | U.S. Pat. No. 8,968,736 SEQ ID NO: 2 | 6413 |
| MP73 | GFRα3 | Heavy chain variable region | H4H2210N | U.S. Pat. No. 8,968,736 SEQ ID NO: 66 | 6427 |
| MP74 | GFRα3 | Heavy chain variable region | H4H2212N | U.S. Pat. No. 8,968,736 SEQ ID NO: 18 | 6411 |
| MP75 | GFRα3 | Heavy chain variable region | H4H2234N | U.S. Pat. No. 8,968,736 SEQ ID NO: 82 | 6428 |
| MP76 | GFRα3 | Heavy chain variable region | H4H2236N3 | U.S. Pat. No. 8,968,736 SEQ ID NO: 34 | 6422 |
| MP77 | GFRα3 | Heavy chain variable region | H4H2243N2 | U.S. Pat. No. 8,968,736 SEQ ID NO: 50 | 6426 |
| MP78 | GFRα3 | Heavy chain variable region | H4H2291S | U.S. Pat. No. 8,968,736 SEQ ID NO: 98 | 6429 |
| MP79 | GFRα3 | Heavy chain variable region | H4H2292S | U.S. Pat. No. 8,968,736 SEQ ID NO: 114 | 6406 |
| MP80 | GFRα3 | Heavy chain variable region | H4H2293P | U.S. Pat. No. 8,968,736 SEQ ID NO: 130 | 6407 |
| MP81 | GFRα3 | Heavy chain variable region | H4H2294S | U.S. Pat. No. 8,968,736 SEQ ID NO: 146 | 6408 |
| MP82 | GFRα3 | Heavy chain variable region | H4H2295S | U.S. Pat. No. 8,968,736 SEQ ID NO: 162 | 6409 |
| MP83 | GFRα3 | Heavy chain variable region | H4H2296S | U.S. Pat. No. 8,968,736 SEQ ID NO: 178 | 6410 |
| MP84 | GFRα3 | Heavy chain variable region | H4H2341S | U.S. Pat. No. 8,968,736 SEQ ID NO: 194 | 6412 |
| MP85 | GFRα3 | Heavy chain variable region | H4H2342P | U.S. Pat. No. 8,968,736 SEQ ID NO: 210 | 6414 |
| MP86 | GFRα3 | Heavy chain variable region | H4H2344S | U.S. Pat. No. 8,968,736 SEQ ID NO: 226 | 6415 |
| MP87 | GFRα3 | Heavy chain variable region | H4H2345S | U.S. Pat. No. 8,968,736 SEQ ID NO: 242 | 6416 |
| MP88 | GFRα3 | Heavy chain variable region | H4H2346S | U.S. Pat. No. 8,968,736 SEQ ID NO: 258 | 6417 |
| MP89 | GFRα3 | Heavy chain variable region | H4H2352S | U.S. Pat. No. 8,968,736 SEQ ID NO: 290 | 6418 |
| MP90 | GFRα3 | Heavy chain variable region | H4H2354S | U.S. Pat. No. 8,968,736 SEQ ID NO: 306 | 6419 |
| MP91 | GFRα3 | Heavy chain variable region | H4H2355S | U.S. Pat. No. 8,968,736 SEQ ID NO: 322 | 6420 |
| MP92 | GFRα3 | Heavy chain variable region | H4H2357S | U.S. Pat. No. 8,968,736 SEQ ID NO: 338 | 6421 |
| MP93 | GFRα3 | Heavy chain variable region | H4H2364S | U.S. Pat. No. 8,968,736 SEQ ID NO: 354 | 6423 |
| MP94 | hNav1.7 | Heavy chain variable region | H1H1015B | WO2014159595 SEQ ID NO: 126 | 6461 |
| MP95 | hNav1.7 | Heavy chain variable region | H1H1019B | WO2014159595 SEQ ID NO: 110 | 6457 |
| MP96 | hNav1.7 | Heavy chain variable region | H1H1021B | WO2014159595 SEQ ID NO: 428 | 6546 |
| MP97 | hNav1.7 | Heavy chain variable region | H1H1022B | WO2014159595 SEQ ID NO: 130 | 6462 |
| MP98 | hNav1.7 | Heavy chain variable region | H1H1023B | WO2014159595 SEQ ID NO: 134 | 6463 |
| MP99 | hNav1.7 | Heavy chain variable region | H1H1026B | WO2014159595 SEQ ID NO: 138 | 6464 |
| MP100 | hNav1.7 | Heavy chain variable region | H1H1028B | WO2014159595 SEQ ID NO: 430 | 6547 |
| MP101 | hNav1.7 | Heavy chain variable region | H1H1029B | WO2014159595 SEQ ID NO: 432 | 6548 |
| MP102 | hNav1.7 | Heavy chain variable region | H1H1030B | WO2014159595 SEQ ID NO: 142 | 6466 |
| MP103 | hNav1.7 | Heavy chain variable region | H1H1032B | WO2014159595 SEQ ID NO: 146 | 6467 |
| MP104 | hNav1.7 | Heavy chain variable region | H1H1036B | WO2014159595 SEQ ID NO: 434 | 6549 |
| MP105 | hNav1.7 | Heavy chain variable region | H1H1038B | WO2014159595 SEQ ID NO: 150 | 6468 |
| MP106 | hNav1.7 | Heavy chain variable region | H1H1039B | WO2014159595 SEQ ID NO: 436 | 6550 |
| MP107 | hNav1.7 | Heavy chain variable region | H1H1040B | WO2014159595 SEQ ID NO: 438 | 6551 |
| MP108 | hNav1.7 | Heavy chain variable region | H1H1041B | WO2014159595 SEQ ID NO: 154 | 6469 |

TABLE 10-continued

Migraine and Pain Antibodies

| Antibody No. | Target | Description | Antibody Name | Reference Information | SEQ ID NO |
|---|---|---|---|---|---|
| MP109 | hNav1.7 | Heavy chain variable region | H1H1042B | WO2014159595 SEQ ID NO: 440 | 6552 |
| MP110 | hNav1.7 | Heavy chain variable region | H1H1044B | WO2014159595 SEQ ID NO: 158 | 6470 |
| MP111 | hNav1.7 | Heavy chain variable region | H1H1045B | WO2014159595 SEQ ID NO: 162 | 6471 |
| MP112 | hNav1.7 | Heavy chain variable region | H1H1050B | WO2014159595 SEQ ID NO: 166 | 6472 |
| MP113 | hNav1.7 | Heavy chain variable region | H1H1052B | WO2014159595 SEQ ID NO: 442 | 6553 |
| MP114 | hNav1.7 | Heavy chain variable region | H1H1055B | WO2014159595 SEQ ID NO: 170 | 6473 |
| MP115 | hNav1.7 | Heavy chain variable region | H1H1056B | WO2014159595 SEQ ID NO: 174 | 6474 |
| MP116 | hNav1.7 | Heavy chain variable region | H1H1058B | WO2014159595 SEQ ID NO: 444 | 6554 |
| MP117 | hNav1.7 | Heavy chain variable region | H1H1059B | WO2014159595 SEQ ID NO: 178 | 6475 |
| MP118 | hNav1.7 | Heavy chain variable region | H1H1060B | WO2014159595 SEQ ID NO: 182 | 6477 |
| MP119 | hNav1.7 | Heavy chain variable region | H1H1061B | WO2014159595 SEQ ID NO: 446 | 6555 |
| MP120 | hNav1.7 | Heavy chain variable region | H1H1065B | WO2014159595 SEQ ID NO: 448 | 6556 |
| MP121 | hNav1.7 | Heavy chain variable region | H1H1066B | WO2014159595 SEQ ID NO: 450 | 6557 |
| MP122 | hNav1.7 | Heavy chain variable region | H1H1067B | WO2014159595 SEQ ID NO: 452 | 6558 |
| MP123 | hNav1.7 | Heavy chain variable region | H1H1068B | WO2014159595 SEQ ID NO: 454 | 6559 |
| MP124 | hNav1.7 | Heavy chain variable region | H1H1076B | WO2014159595 SEQ ID NO: 456 | 6560 |
| MP125 | hNav1.7 | Heavy chain variable region | H1H1089B | WO2014159595 SEQ ID NO: 458 | 6561 |
| MP126 | hNav1.7 | Heavy chain variable region | H1H1090B | WO2014159595 SEQ ID NO: 460 | 6563 |
| MP127 | hNav1.7 | Heavy chain variable region | H1H1097B | WO2014159595 SEQ ID NO: 462 | 6564 |
| MP128 | hNav1.7 | Heavy chain variable region | H1H1100B | WO2014159595 SEQ ID NO: 464 | 6565 |
| MP129 | hNav1.7 | Heavy chain variable region | H1H1102B | WO2014159595 SEQ ID NO: 466 | 6566 |
| MP130 | hNav1.7 | Heavy chain variable region | H1H1106B | WO2014159595 SEQ ID NO: 468 | 6567 |
| MP131 | hNav1.7 | Heavy chain variable region | H1H1107B | WO2014159595 SEQ ID NO: 470 | 6568 |
| MP132 | hNav1.7 | Heavy chain variable region | H1H1108B | WO2014159595 SEQ ID NO: 472 | 6569 |
| MP133 | hNav1.7 | Heavy chain variable region | H1H1109B | WO2014159595 SEQ ID NO: 474 | 6570 |
| MP134 | hNav1.7 | Heavy chain variable region | H1H1111B | WO2014159595 SEQ ID NO: 476 | 6571 |
| MP135 | hNav1.7 | Heavy chain variable region | H1H1114B | WO2014159595 SEQ ID NO: 426 | 6545 |
| MP136 | hNav1.7 | Heavy chain variable region | H1H1117B | WO2014159595 SEQ ID NO: 478 | 6572 |
| MP137 | hNav1.7 | Heavy chain variable region | H1H1118B | WO2014159595 SEQ ID NO: 480 | 6573 |
| MP138 | hNav1.7 | Heavy chain variable region | H1H1119B | WO2014159595 SEQ ID NO: 482 | 6574 |
| MP139 | hNav1.7 | Heavy chain variable region | H1H1121B | WO2014159595 SEQ ID NO: 484 | 6575 |
| MP140 | hNav1.7 | Heavy chain variable region | H1H1126B | WO2014159595 SEQ ID NO: 486 | 6576 |
| MP141 | hNav1.7 | Heavy chain variable region | H1H1130B | WO2014159595 SEQ ID NO: 488 | 6577 |
| MP142 | hNav1.7 | Heavy chain variable region | H1H1131B | WO2014159595 SEQ ID NO: 490 | 6578 |
| MP143 | hNav1.7 | Heavy chain variable region | H1H1133B | WO2014159595 SEQ ID NO: 492 | 6579 |
| MP144 | hNav1.7 | Heavy chain variable region | H1H1134B | WO2014159595 SEQ ID NO: 494 | 6580 |
| MP145 | hNav1.7 | Heavy chain variable region | H1H1135B | WO2014159595 SEQ ID NO: 496 | 6581 |

TABLE 10-continued

Migraine and Pain Antibodies

| Antibody No. | Target | Description | Antibody Name | Reference Information | SEQ ID NO |
|---|---|---|---|---|---|
| MP146 | hNav1.7 | Heavy chain variable region | H1H1137B | WO2014159595 SEQ ID NO: 498 | 6582 |
| MP147 | hNav1.7 | Heavy chain variable region | H1H1139B | WO2014159595 SEQ ID NO: 500 | 6584 |
| MP148 | hNav1.7 | Heavy chain variable region | H1H1141B | WO2014159595 SEQ ID NO: 502 | 6585 |
| MP149 | hNav1.7 | Heavy chain variable region | H1H1149B | WO2014159595 SEQ ID NO: 504 | 6586 |
| MP150 | hNav1.7 | Heavy chain variable region | H1H1153B | WO2014159595 SEQ ID NO: 506 | 6587 |
| MP151 | hNav1.7 | Heavy chain variable region | H1H1156B | WO2014159595 SEQ ID NO: 508 | 6588 |
| MP152 | hNav1.7 | Heavy chain variable region | H1H1157B | WO2014159595 SEQ ID NO: 510 | 6589 |
| MP153 | hNav1.7 | Heavy chain variable region | H1H1158B | WO2014159595 SEQ ID NO: 512 | 6590 |
| MP154 | hNav1.7 | Heavy chain variable region | H1H1162B | WO2014159595 SEQ ID NO: 514 | 6591 |
| MP155 | hNav1.7 | Heavy chain variable region | H1H1172B | WO2014159595 SEQ ID NO: 516 | 6592 |
| MP156 | hNav1.7 | Heavy chain variable region | H2M799N | WO2014159595 SEQ ID NO: 823 | 6631 |
| MP157 | hNav1.7 | Heavy chain variable region | H4H1003P | WO2014159595 SEQ ID NO: 860 | 6633 |
| MP158 | hNav1.7 | Heavy chain variable region | H4H1025P | WO2014159595 SEQ ID NO: 872 | 6636 |
| MP159 | hNav1.7 | Heavy chain variable region | H4H361 B | WO2014159595 SEQ ID NO: 234 | 6492 |
| MP160 | hNav1.7 | Heavy chain variable region | H4H362B | WO2014159595 SEQ ID NO: 30 | 6510 |
| MP161 | hNav1.7 | Heavy chain variable region | H4H362P | WO2014159595 SEQ ID NO: 868 | 6635 |
| MP162 | hNav1.7 | Heavy chain variable region | H4H365B | WO2014159595 SEQ ID NO: 238 | 6493 |
| MP163 | hNav1.7 | Heavy chain variable region | H4H367B | WO2014159595 SEQ ID NO: 34 | 6521 |
| MP164 | hNav1.7 | Heavy chain variable region | H4H368B | WO2014159595 SEQ ID NO: 38 | 6532 |
| MP165 | hNav1.7 | Heavy chain variable region | H4H370B | WO2014159595 SEQ ID NO: 518 | 6593 |
| MP166 | hNav1.7 | Heavy chain variable region | H4H371 B | WO2014159595 SEQ ID NO: 242 | 6494 |
| MP167 | hNav1.7 | Heavy chain variable region | H4H372B | WO2014159595 SEQ ID NO: 246 | 6495 |
| MP168 | hNav1.7 | Heavy chain variable region | H4H373B | WO2014159595 SEQ ID NO: 250 | 6496 |
| MP169 | hNav1.7 | Heavy chain variable region | H4H378B | WO2014159595 SEQ ID NO: 520 | 6594 |
| MP170 | hNav1.7 | Heavy chain variable region | H4H379B | WO2014159595 SEQ ID NO: 254 | 6497 |
| MP171 | hNav1.7 | Heavy chain variable region | H4H381 B | WO2014159595 SEQ ID NO: 258 | 6498 |
| MP172 | hNav1.7 | Heavy chain variable region | H4H382B | WO2014159595 SEQ ID NO: 42 | 6543 |
| MP173 | hNav1.7 | Heavy chain variable region | H4H383B | WO2014159595 SEQ ID NO: 522 | 6595 |
| MP174 | hNav1.7 | Heavy chain variable region | H4H385B | WO2014159595 SEQ ID NO: 262 | 6500 |
| MP175 | hNav1.7 | Heavy chain variable region | H4H385B | WO2014159595 SEQ ID NO: 681 | 6613 |
| MP176 | hNav1.7 | Heavy chain variable region | H4H388B | WO2014159595 SEQ ID NO: 266 | 6501 |
| MP177 | hNav1.7 | Heavy chain variable region | H4H389B | WO2014159595 SEQ ID NO: 524 | 6596 |
| MP178 | hNav1.7 | Heavy chain variable region | H4H391B | WO2014159595 SEQ ID NO: 46 | 6562 |
| MP179 | hNav1.7 | Heavy chain variable region | H4H391P | WO2014159595 SEQ ID NO: 50 | 6583 |
| MP180 | hNav1.7 | Heavy chain variable region | H4H395B | WO2014159595 SEQ ID NO: 685 | 6614 |
| MP181 | hNav1.7 | Heavy chain variable region | H4H396B | WO2014159595 SEQ ID NO: 270 | 6502 |
| MP182 | hNav1.7 | Heavy chain variable region | H4H397B | WO2014159595 SEQ ID NO: 54 | 6604 |

TABLE 10-continued

Migraine and Pain Antibodies

| Antibody No. | Target | Description | Antibody Name | Reference Information | SEQ ID NO |
|---|---|---|---|---|---|
| MP183 | hNav1.7 | Heavy chain variable region | H4H398B | WO2014159595 SEQ ID NO: 274 | 6503 |
| MP184 | hNav1.7 | Heavy chain variable region | H4H399B | WO2014159595 SEQ ID NO: 278 | 6504 |
| MP185 | hNav1.7 | Heavy chain variable region | H4H400B | WO2014159595 SEQ ID NO: 282 | 6505 |
| MP186 | hNav1.7 | Heavy chain variable region | H4H402B | WO2014159595 SEQ ID NO: 286 | 6506 |
| MP187 | hNav1.7 | Heavy chain variable region | H4H405B | WO2014159595 SEQ ID NO: 526 | 6597 |
| MP188 | hNav1.7 | Heavy chain variable region | H4H407B | WO2014159595 SEQ ID NO: 528 | 6598 |
| MP189 | hNav1.7 | Heavy chain variable region | H4H408B | WO2014159595 SEQ ID NO: 58 | 6609 |
| MP190 | hNav1.7 | Heavy chain variable region | H4H409B | WO2014159595 SEQ ID NO: 290 | 6507 |
| MP191 | hNav1.7 | Heavy chain variable region | H4H413B | WO2014159595 SEQ ID NO: 530 | 6599 |
| MP192 | hNav1.7 | Heavy chain variable region | H4H415B | WO2014159595 SEQ ID NO: 294 | 6508 |
| MP193 | hNav1.7 | Heavy chain variable region | H4H416B | WO2014159595 SEQ ID NO: 298 | 6509 |
| MP194 | hNav1.7 | Heavy chain variable region | H4H419B | WO2014159595 SEQ ID NO: 302 | 6511 |
| MP195 | hNav1.7 | Heavy chain variable region | H4H422B | WO2014159595 SEQ ID NO: 306 | 6512 |
| MP196 | hNav1.7 | Heavy chain variable region | H4H426B | WO2014159595 SEQ ID NO: 62 | 6611 |
| MP197 | hNav1.7 | Heavy chain variable region | H4H427B | WO2014159595 SEQ ID NO: 532 | 6600 |
| MP198 | hNav1.7 | Heavy chain variable region | H4H432B | WO2014159595 SEQ ID NO: 534 | 6601 |
| MP199 | hNav1.7 | Heavy chain variable region | H4H434B | WO2014159595 SEQ ID NO: 310 | 6513 |
| MP200 | hNav1.7 | Heavy chain variable region | H4H434B | WO2014159595 SEQ ID NO: 689 | 6615 |
| MP201 | hNav1.7 | Heavy chain variable region | H4H434P | WO2014159595 SEQ ID NO: 693 | 6616 |
| MP202 | hNav1.7 | Heavy chain variable region | H4H436B | WO2014159595 SEQ ID NO: 536 | 6602 |
| MP203 | hNav1.7 | Heavy chain variable region | H4H437B | WO2014159595 SEQ ID NO: 538 | 6603 |
| MP204 | hNav1.7 | Heavy chain variable region | H4H438B | WO2014159595 SEQ ID NO: 314 | 6514 |
| MP205 | hNav1.7 | Heavy chain variable region | H4H438B | WO2014159595 SEQ ID NO: 697 | 6617 |
| MP206 | hNav1.7 | Heavy chain variable region | H4H439B | WO2014159595 SEQ ID NO: 66 | 6612 |
| MP207 | hNav1.7 | Heavy chain variable region | H4H439P | WO2014159595 SEQ ID NO: 70 | 6618 |
| MP208 | hNav1.7 | Heavy chain variable region | H4H441 B | WO2014159595 SEQ ID NO: 701 | 6619 |
| MP209 | hNav1.7 | Heavy chain variable region | H4H441 P | WO2014159595 SEQ ID NO: 864 | 6634 |
| MP210 | hNav1.7 | Heavy chain variable region | H4H442B | WO2014159595 SEQ ID NO: 318 | 6515 |
| MP211 | hNav1.7 | Heavy chain variable region | H4H443B | WO2014159595 SEQ ID NO: 74 | 6624 |
| MP212 | hNav1.7 | Heavy chain variable region | H4H444B | WO2014159595 SEQ ID NO: 322 | 6516 |
| MP213 | hNav1.7 | Heavy chain variable region | H4H445B | WO2014159595 SEQ ID NO: 540 | 6605 |
| MP214 | hNav1.7 | Heavy chain variable region | H4H446B | WO2014159595 SEQ ID NO: 326 | 6517 |
| MP215 | hNav1.7 | Heavy chain variable region | H4H448B | WO2014159595 SEQ ID NO: 78 | 6627 |
| MP216 | hNav1.7 | Heavy chain variable region | H4H453B | WO2014159595 SEQ ID NO: 542 | 6606 |
| MP217 | hNav1.7 | Heavy chain variable region | H4H456B | WO2014159595 SEQ ID NO: 330 | 6518 |
| MP218 | hNav1.7 | Heavy chain variable region | H4H457B | WO2014159595 SEQ ID NO: 334 | 6519 |
| MP219 | hNav1.7 | Heavy chain variable region | H4H458B | WO2014159595 SEQ ID NO: 338 | 6520 |

TABLE 10-continued

Migraine and Pain Antibodies

| Antibody No. | Target | Description | Antibody Name | Reference Information | SEQ ID NO |
|---|---|---|---|---|---|
| MP220 | hNav1.7 | Heavy chain variable region | H4H460B | WO2014159595 SEQ ID NO: 342 | 6522 |
| MP221 | hNav1.7 | Heavy chain variable region | H4H461 B | WO2014159595 SEQ ID NO: 346 | 6523 |
| MP222 | hNav1.7 | Heavy chain variable region | H4H462B | WO2014159595 SEQ ID NO: 350 | 6524 |
| MP223 | hNav1.7 | Heavy chain variable region | H4H463B | WO2014159595 SEQ ID NO: 354 | 6525 |
| MP224 | hNav1.7 | Heavy chain variable region | H4H464B | WO2014159595 SEQ ID NO: 358 | 6526 |
| MP225 | hNav1.7 | Heavy chain variable region | H4H465B | WO2014159595 SEQ ID NO: 362 | 6527 |
| MP226 | hNav1.7 | Heavy chain variable region | H4H466B | WO2014159595 SEQ ID NO: 366 | 6528 |
| MP227 | hNav1.7 | Heavy chain variable region | H4H467B | WO2014159595 SEQ ID NO: 370 | 6529 |
| MP228 | hNav1.7 | Heavy chain variable region | H4H468B | WO2014159595 SEQ ID NO: 82 | 6630 |
| MP229 | hNav1.7 | Heavy chain variable region | H4H468P | WO2014159595 SEQ ID NO: 86 | 6632 |
| MP230 | hNav1.7 | Heavy chain variable region | H4H471B | WO2014159595 SEQ ID NO: 90 | 6637 |
| MP231 | hNav1.7 | Heavy chain variable region | H4H471P | WO2014159595 SEQ ID NO: 94 | 6638 |
| MP232 | hNav1.7 | Heavy chain variable region | H4H472B | WO2014159595 SEQ ID NO: 374 | 6530 |
| MP233 | hNav1.7 | Heavy chain variable region | H4H473B | WO2014159595 SEQ ID NO: 378 | 6531 |
| MP234 | hNav1.7 | Heavy chain variable region | H4H475B | WO2014159595 SEQ ID NO: 382 | 6533 |
| MP235 | hNav1.7 | Heavy chain variable region | H4H477B | WO2014159595 SEQ ID NO: 386 | 6534 |
| MP236 | hNav1.7 | Heavy chain variable region | H4H478B | WO2014159595 SEQ ID NO: 544 | 6607 |
| MP237 | hNav1.7 | Heavy chain variable region | H4H480B | WO2014159595 SEQ ID NO: 390 | 6535 |
| MP238 | hNav1.7 | Heavy chain variable region | H4H481 B | WO2014159595 SEQ ID NO: 394 | 6536 |
| MP239 | hNav1.7 | Heavy chain variable region | H4H482B | WO2014159595 SEQ ID NO: 398 | 6537 |
| MP240 | hNav1.7 | Heavy chain variable region | H4H483B | WO2014159595 SEQ ID NO: 402 | 6538 |
| MP241 | hNav1.7 | Heavy chain variable region | H4H484B | WO2014159595 SEQ ID NO: 406 | 6539 |
| MP242 | hNav1.7 | Heavy chain variable region | H4H486B | WO2014159595 SEQ ID NO: 410 | 6540 |
| MP243 | hNav1.7 | Heavy chain variable region | H4H488B | WO2014159595 SEQ ID NO: 414 | 6541 |
| MP244 | hNav1.7 | Heavy chain variable region | H4H489B | WO2014159595 SEQ ID NO: 418 | 6542 |
| MP245 | hNav1.7 | Heavy chain variable region | H4H490B | WO2014159595 SEQ ID NO: 546 | 6608 |
| MP246 | hNav1.7 | Heavy chain variable region | H4H491B | WO2014159595 SEQ ID NO: 422 | 6544 |
| MP247 | hNav1.7 | Heavy chain variable region | H1 H1 105B | WO2014159595 SEQ ID NO: 198 | 6481 |
| MP248 | hNav1.7 | Heavy chain variable region | H1 H1 123B | WO2014159595 SEQ ID NO: 202 | 6483 |
| MP249 | hNav1.7 | Heavy chain variable region | H1 H1 138B | WO2014159595 SEQ ID NO: 206 | 6484 |
| MP250 | hNav1.7 | Heavy chain variable region | H1 H1 144B | WO2014159595 SEQ ID NO: 210 | 6485 |
| MP251 | hNav1.7 | Heavy chain variable region | H1 H1 147B | WO2014159595 SEQ ID NO: 214 | 6486 |
| MP252 | hNav1.7 | Heavy chain variable region | H1 H1 155B | WO2014159595 SEQ ID NO: 218 | 6487 |
| MP253 | hNav1.7 | Heavy chain variable region | H1 H1 164B | WO2014159595 SEQ ID NO: 222 | 6489 |
| MP254 | hNav1.7 | Heavy chain variable region | H1 H1 166B | WO2014159595 SEQ ID NO: 226 | 6490 |
| MP255 | hNav1.7 | Heavy chain variable region | H1 H1 169B | WO2014159595 SEQ ID NO: 230 | 6491 |
| MP256 | hNav1.7 | Heavy chain variable region | H1 H1006P | WO2014159595 SEQ ID NO: 705 | 6620 |

TABLE 10-continued

Migraine and Pain Antibodies

| Antibody No. | Target | Description | Antibody Name | Reference Information | SEQ ID NO |
|---|---|---|---|---|---|
| MP257 | hNav1.7 | Heavy chain variable region | H1 H1025B | WO2014159595 SEQ ID NO: 722 | 6622 |
| MP258 | hNav1.7 | Heavy chain variable region | H1 H1068B | WO2014159595 SEQ ID NO: 709 | 6621 |
| MP259 | hNav1.7 | Heavy chain variable region | H1 H1069B | WO2014159595 SEQ ID NO: 186 | 6478 |
| MP260 | hNav1.7 | Heavy chain variable region | H1 H1082B | WO2014159595 SEQ ID NO: 190 | 6479 |
| MP261 | hNav1.7 | Heavy chain variable region | H1 H1098B | WO2014159595 SEQ ID NO: 194 | 6480 |
| MP262 | hNav1.7 | Heavy chain variable region | H1 M683N | WO2014159595 SEQ ID NO: 2 | 6482 |
| MP263 | hNav1.7 | Heavy chain variable region | H1 M797N | WO2014159595 SEQ ID NO: 6 | 6610 |
| MP264 | hNav1.7 | Heavy chain variable region | H1 M799N | WO2014159595 SEQ ID NO: 26 | 6499 |
| MP265 | hNav1.7 | Heavy chain variable region | H1 M801 N | WO2014159595 SEQ ID NO: 727 | 6623 |
| MP266 | hNav1.7 | Heavy chain variable region | H1 M826N | WO2014159595 SEQ ID NO: 743 | 6625 |
| MP267 | hNav1.7 | Heavy chain variable region | H1 M834N | WO2014159595 SEQ ID NO: 10 | 6454 |
| MP268 | hNav1.7 | Heavy chain variable region | H1 M836N | WO2014159595 SEQ ID NO: 759 | 6626 |
| MP269 | hNav1.7 | Heavy chain variable region | H1 M839N | WO2014159595 SEQ ID NO: 14 | 6465 |
| MP270 | hNav1.7 | Heavy chain variable region | H1 M852N | WO2014159595 SEQ ID NO: 18 | 6476 |
| MP271 | hNav1.7 | Heavy chain variable region | H1 M875N | WO2014159595 SEQ ID NO: 22 | 6488 |
| MP272 | hNav1.7 | Heavy chain variable region | H1 M879N | WO2014159595 SEQ ID NO: 791 | 6628 |
| MP273 | hNav1.7 | Heavy chain variable region | H1 M994N | WO2014159595 SEQ ID NO: 807 | 6629 |
| MP274 | hNav1.7 | Heavy chain variable region | H1H1003B | WO2014159595 SEQ ID NO: 98 | 6639 |
| MP275 | hNav1.7 | Heavy chain variable region | H1H1006B | WO2014159595 SEQ ID NO: 102 | 6455 |
| MP276 | hNav1.7 | Heavy chain variable region | H1H1008B | WO2014159595 SEQ ID NO: 106 | 6456 |
| MP277 | hNav1.7 | Heavy chain variable region | H1H1010B | WO2014159595 SEQ ID NO: 114 | 6458 |
| MP278 | hNav1.7 | Heavy chain variable region | H1H1011B | WO2014159595 SEQ ID NO: 118 | 6459 |
| MP279 | hNav1.7 | Heavy chain variable region | H1H1013B | WO2014159595 SEQ ID NO: 122 | 6460 |
| MP280 | TNF | Heavy chain variable region | | US20030157061 SEQ ID NO: 2 | 6955 |
| MP281 | TNF | Heavy chain variable region | | US20030157061 SEQ ID NO: 6 | 6956 |
| MP282 | TrkA | Heavy chain variable region | HuVHWO | WO2009098238 SEQ ID NO: 17 | 3856 |
| MP283 | NGF | Heavy chain, Antibody for chronic pain | Fulranumab, 4D4, AMG-403, JNJ-42160443 | U.S. Pat. No. 7,601,818 SEQ ID NO: 40 | 17701 |
| MP284 | NGF | Heavy chain, Antibody for chronic pain | Fasinumab, REGN475, SAR164877 | | 17702 |
| MP285 | NGF | Heavy chain, Antibody for pain, chronic and acute, osteoarthritis | Tanezumab, PF-04383119, RN 624, E3 | US20040237124 SEQ ID NO: 1 | 17703 |
| MP286 | CGRP | Light chain | G1, cluster headache | U.S. Pat. No. 9,115,194 SEQ ID NO: 12 | 17704 |
| MP287 | CGRP | Light chain | 04E4 | U.S. Pat. No. 9,102,731 SEQ ID NO: 17 | 17705 |
| MP288 | CGRP | Light chain | 10E4 | U.S. Pat. No. 9,102,731 SEQ ID NO: 22 | 17706 |
| MP289 | CGRP | Light chain | 02E7 | U.S. Pat. No. 9,102,731 SEQ ID NO: 14 | 17707 |
| MP290 | CGRP | Light chain | 12E8 | U.S. Pat. No. 9,102,731 SEQ ID NO: 25 | 17708 |

TABLE 10-continued

Migraine and Pain Antibodies

| Antibody No. | Target | Description | Antibody Name | Reference Information | SEQ ID NO |
|---|---|---|---|---|---|
| MP291 | CGRP | Light chain | 01E11 | U.S. Pat. No. 9,102,731 SEQ ID NO: 12 | 17709 |
| MP292 | CGRP | Light chain | 01H7 | U.S. Pat. No. 9,102,731 SEQ ID NO: 13 | 17710 |
| MP293 | CGRP | Light chain | 03B6 | U.S. Pat. No. 9,102,731 SEQ ID NO: 15 | 17711 |
| MP294 | CGRP | Light chain | 03C8 | U.S. Pat. No. 9,102,731 SEQ ID NO: 16 | 17712 |
| MP295 | CGRP | Light chain | 04H6 | U.S. Pat. No. 9,102,731 SEQ ID NO: 18 | 17713 |
| MP296 | CGRP | Light chain | 05F5 | U.S. Pat. No. 9,102,731 SEQ ID NO: 19 | 17714 |
| MP297 | CGRP | Light chain | 09D4 | U.S. Pat. No. 9,102,731 SEQ ID NO: 20 | 17715 |
| MP298 | CGRP | Light chain | 09F5 | U.S. Pat. No. 9,102,731 SEQ ID NO: 21 | 17716 |
| MP299 | CGRP | Light chain | 11D11 HL | U.S. Pat. No. 9,102,731 SEQ ID NO: 23 | 17717 |
| MP300 | CGRP | Light chain | 11H9 | U.S. Pat. No. 9,102,731 SEQ ID NO: 24 | 17718 |
| MP301 | CGRP | Light chain | 12G8 HL | U.S. Pat. No. 9,102,731 SEQ ID NO: 26 | 17719 |
| MP302 | CGRP | Light chain | 13H2 | U.S. Pat. No. 9,102,731 SEQ ID NO: 27 | 17720 |
| MP303 | CGRP | Light chain | 32H7 | U.S. Pat. No. 9,102,731 SEQ ID NO: 28 | 17721 |
| MP304 | CGRP | Light chain | A | US20120294802 SEQ ID NO: 1 | 17722 |
| MP305 | CGRP | Light chain | Ab1 | US20120294802 SEQ ID NO: 2 | 17723 |
| MP306 | CGRP | Light chain | Ab10 | US20120294802 SEQ ID NO: 92 | 17724 |
| MP307 | CGRP | Light chain | Ab11 | US20120294802 SEQ ID NO: 102 | 17725 |
| MP308 | CGRP | Light chain | Ab12 | US20120294802 SEQ ID NO: 112 | 17726 |
| MP309 | CGRP | Light chain | Ab13 | US20120294802 SEQ ID NO: 122 | 17727 |
| MP310 | CGRP | Light chain | Ab14 | US20120294802 SEQ ID NO: 132 | 17728 |
| MP311 | CGRP | Light chain | Ab2 | US20120294802 SEQ ID NO: 12 | 17729 |
| MP312 | CGRP | Light chain | Ab3 | US20120294802 SEQ ID NO: 22 | 17730 |
| MP313 | CGRP | Light chain | Ab4 | US20120294802 SEQ ID NO: 32 | 17731 |
| MP314 | CGRP | Light chain | Ab5 | US20120294802 SEQ ID NO: 42 | 17732 |
| MP315 | CGRP | Light chain | Ab6 | US20120294802 SEQ ID NO: 52 | 17733 |
| MP316 | CGRP | Light chain | Ab7 | US20120294802 SEQ ID NO: 62 | 17734 |
| MP317 | CGRP | Light chain | Ab8 | US20120294802 SEQ ID NO: 72 | 17735 |
| MP318 | CGRP | Light chain | Ab9 | US20120294802 SEQ ID NO: 82 | 17736 |
| MP319 | CGRP | Light chain | B | US20120294802 SEQ ID NO: 11 | 17737 |
| MP320 | CGRP | Light chain | C | US20120294802 SEQ ID NO: 21 | 17738 |
| MP321 | CGRP | Light chain | D | US20120294802 SEQ ID NO: 31 | 17739 |
| MP322 | CGRP | Light chain | E | US20120294802 SEQ ID NO: 41 | 17740 |
| MP323 | CGRP | Light chain | F | US20120294802 SEQ ID NO: 51 | 17741 |
| MP324 | CGRP | Light chain | G | US20120294802 SEQ ID NO: 61 | 17742 |
| MP325 | CGRP | Light chain | H | US20120294802 SEQ ID NO: 71 | 17743 |
| MP326 | CGRP | Light chain | I | US20120294802 SEQ ID NO: 81 | 17744 |
| MP327 | CGRP | Light chain | J | US20120294802 SEQ ID NO: 91 | 17745 |

TABLE 10-continued

Migraine and Pain Antibodies

| Antibody No. | Target | Description | Antibody Name | Reference Information | SEQ ID NO |
|---|---|---|---|---|---|
| MP328 | CGRP | Light chain | K | US20120294802 SEQ ID NO: 101 | 17746 |
| MP329 | CGRP | Light chain | L | US20120294802 SEQ ID NO: 111 | 17747 |
| MP330 | CGRP | Light chain | M | US20120294802 SEQ ID NO: 121 | 17748 |
| MP331 | CGRP | Light chain | N | US20120294802 SEQ ID NO: 131 | 17749 |
| MP332 | TrkA | Light chain | BXhVH5VL1, GBR VH5(K3Q)VL1, GBR VH5(V37A)VL1, GBR VH5(V37A)VL1(*), GBR VH5(G42E)VL1, GBR VH5(V89L)VL1, GBR VH5(R94K)VL1, GBR VH5(K3Q, V37A)VL1, GBR VH5(K3Q, V37A)VL1(*), GBR VH5(K3Q, T40A)VL1, GBR VH5(P60A, T62S)VL1, GBR VH5(K3Q, V37A, R44G)VL1, GBR VH5(K3Q, A49S, Y50A)VL1, GBR VH5(K3Q, P60A, T62S)VL1, GBR VH5(K3Q, T40A, P60A, T62S)VL1, GBR VH5(K3Q, V37A, T40A, P60A, T62S)VL1, GBR VH5(K3Q, T40A, R44G, A49S, Y50A)VL1, GBR VH5(K3Q, A49S, Y50A, P60A, T62S)VL1, GBR VH5(K3Q, T40A, R44G, A49S, Y50A, P60A, T62S)VL1, GBR VH5(K3Q, T40A, R44G, | US20150183885 SEQ ID NO: 29 | 7905 |

TABLE 10-continued

Migraine and Pain Antibodies

| Antibody No. | Target | Description | Antibody Name | Reference Information | SEQ ID NO |
|---|---|---|---|---|---|
| | | | A49S, Y50A, P60A, T62S, R94K)VL1 | | |
| MP333 | TrkA | Light chain | BXhVL2 | WO2009098238 SEQ ID NO: 8 | 3897 |
| MP334 | TrkA | Light chain | BXhVL3 | WO2009098238 SEQ ID NO: 9 | 3898 |
| MP335 | TrkA | Light chain | BXhVL4 | WO2009098238 SEQ ID NO: 10 | 3890 |
| MP336 | TrkA | Light chain | BXhVL5 | WO2009098238 SEQ ID NO: 11 | 3891 |
| MP337 | TrkA | Light chain | BXhVL7 | WO2009098238 SEQ ID NO: 13 | 3893 |
| MP338 | TrkA | Light chain | BXhVL8 | WO2009098238 SEQ ID NO: 14 | 3894 |
| MP339 | TrkA | Light chain | BXhVL1 | WO2009098238 SEQ ID NO: 7 | 3896 |
| MP340 | TrkA | Light chain | BXhVLβ | WO2009098238 SEQ ID NO: 12 | 3892 |
| MP341 | TrkA | Light chain | mVLEP | WO2009098238 SEQ ID NO: 16 | 3895 |
| MP342 | GFRα3 | Light chain variable region | H1M2236N | U.S. Pat. No. 8,968,736 SEQ ID NO: 405 | 8817 |
| MP343 | GFRα3 | Light chain variable region | H1M2243N | U.S. Pat. No. 8,968,736 SEQ ID NO: 389 | 8816 |
| MP344 | GFRα3 | Light chain variable region | H4H2207N | U.S. Pat. No. 8,968,736 SEQ ID NO: 10 | 8797 |
| MP345 | GFRα3 | Light chain variable region | H4H2210N | U.S. Pat. No. 8,968,736 SEQ ID NO: 74 | 8820 |
| MP346 | GFRα3 | Light chain variable region | H4H2212N | U.S. Pat. No. 8,968,736 SEQ ID NO: 26 | 8808 |
| MP347 | GFRα3 | Light chain variable region | H4H2234N | U.S. Pat. No. 8,968,736 SEQ ID NO: 90 | 8821 |
| MP348 | GFRα3 | Light chain variable region | H4H2236N3 | U.S. Pat. No. 8,968,736 SEQ ID NO: 42 | 8818 |
| MP349 | GFRα3 | Light chain variable region | H4H2243N2 | U.S. Pat. No. 8,968,736 SEQ ID NO: 58 | 8819 |
| MP350 | GFRα3 | Light chain variable region | H4H2291S | U.S. Pat. No. 8,968,736 SEQ ID NO: 106 | 8798 |
| MP351 | GFRα3 | Light chain variable region | H4H2292S | U.S. Pat. No. 8,968,736 SEQ ID NO: 122 | 8799 |
| MP352 | GFRα3 | Light chain variable region | H4H2293P | U.S. Pat. No. 8,968,736 SEQ ID NO: 138 | 8800 |
| MP353 | GFRα3 | Light chain variable region | H4H2294S | U.S. Pat. No. 8,968,736 SEQ ID NO: 154 | 8801 |
| MP354 | GFRα3 | Light chain variable region | H4H2295S | U.S. Pat. No. 8,968,736 SEQ ID NO: 170 | 8802 |
| MP355 | GFRα3 | Light chain variable region | H4H2296S | U.S. Pat. No. 8,968,736 SEQ ID NO: 186 | 8803 |
| MP356 | GFRα3 | Light chain variable region | H4H2341S | U.S. Pat. No. 8,968,736 SEQ ID NO: 202 | 8804 |
| MP357 | GFRα3 | Light chain variable region | H4H2342P | U.S. Pat. No. 8,968,736 SEQ ID NO: 218 | 8805 |
| MP358 | GFRα3 | Light chain variable region | H4H2344S | U.S. Pat. No. 8,968,736 SEQ ID NO: 234 | 8806 |
| MP359 | GFRα3 | Light chain variable region | H4H2345S | U.S. Pat. No. 8,968,736 SEQ ID NO: 250 | 8807 |
| MP360 | GFRα3 | Light chain variable region | H4H2346S | U.S. Pat. No. 8,968,736 SEQ ID NO: 266 | 8809 |
| MP361 | GFRα3 | Light chain variable region | H4H2350P | U.S. Pat. No. 8,968,736 SEQ ID NO: 282 | 8810 |
| MP362 | GFRα3 | Light chain variable region | H4H2352S | U.S. Pat. No. 8,968,736 SEQ ID NO: 298 | 8811 |
| MP363 | GFRα3 | Light chain variable region | H4H2354S | U.S. Pat. No. 8,968,736 SEQ ID NO: 314 | 8812 |
| MP364 | GFRα3 | Light chain variable region | H4H2355S | U.S. Pat. No. 8,968,736 SEQ ID NO: 330 | 8813 |
| MP365 | GFRα3 | Light chain variable region | H4H2357S | U.S. Pat. No. 8,968,736 SEQ ID NO: 346 | 8814 |
| MP366 | GFRα3 | Light chain variable region | H4H2364S | U.S. Pat. No. 8,968,736 SEQ ID NO: 362 | 8815 |
| MP367 | hNav1.7 | Light chain variable region | H1 H1 105B | WO2014159595 SEQ ID NO: 200 | 8870 |
| MP368 | hNav1.7 | Light chain variable region | H1 H1 138B | WO2014159595 SEQ ID NO: 208 | 8871 |

TABLE 10-continued

Migraine and Pain Antibodies

| Antibody No. | Target | Description | Antibody Name | Reference Information | SEQ ID NO |
|---|---|---|---|---|---|
| MP369 | hNav1.7 | Light chain variable region | H1 H1 144B | WO2014159595 SEQ ID NO: 212 | 8872 |
| MP370 | hNav1.7 | Light chain variable region | H1 H1 147B | WO2014159595 SEQ ID NO: 216 | 8873 |
| MP371 | hNav1.7 | Light chain variable region | H1 H1 155B | WO2014159595 SEQ ID NO: 220 | 8874 |
| MP372 | hNav1.7 | Light chain variable region | H1 H1 164B | WO2014159595 SEQ ID NO: 224 | 8875 |
| MP373 | hNav1.7 | Light chain variable region | H1 H1 166B | WO2014159595 SEQ ID NO: 228 | 8876 |
| MP374 | hNav1.7 | Light chain variable region | H1 H1 169B | WO2014159595 SEQ ID NO: 232 | 8877 |
| MP375 | hNav1.7 | Light chain variable region | H1 H1006P | WO2014159595 SEQ ID NO: 707 | 9006 |
| MP376 | hNav1.7 | Light chain variable region | H1 H1025B | WO2014159595 SEQ ID NO: 724 | 9009 |
| MP377 | hNav1.7 | Light chain variable region | H1 H1068B | WO2014159595 SEQ ID NO: 711 | 9007 |
| MP378 | hNav1.7 | Light chain variable region | H1 H1069B | WO2014159595 SEQ ID NO: 188 | 8866 |
| MP379 | hNav1.7 | Light chain variable region | H1 H1082B | WO2014159595 SEQ ID NO: 192 | 8867 |
| MP380 | hNav1.7 | Light chain variable region | H1 H1098B | WO2014159595 SEQ ID NO: 196 | 8868 |
| MP381 | hNav1.7 | Light chain variable region | H1 M683N | WO2014159595 SEQ ID NO: 4 | 8923 |
| MP382 | hNav1.7 | Light chain variable region | H1 M797N | WO2014159595 SEQ ID NO: 8 | 9015 |
| MP383 | hNav1.7 | Light chain variable region | H1 M799N | WO2014159595 SEQ ID NO: 28 | 8890 |
| MP384 | hNav1.7 | Light chain variable region | H1 M801 N | WO2014159595 SEQ ID NO: 735 | 9010 |
| MP385 | hNav1.7 | Light chain variable region | H1 M826N | WO2014159595 SEQ ID NO: 751 | 9011 |
| MP386 | hNav1.7 | Light chain variable region | H1 M834N | WO2014159595 SEQ ID NO: 12 | 8847 |
| MP387 | hNav1.7 | Light chain variable region | H1 M836N | WO2014159595 SEQ ID NO: 767 | 9013 |
| MP388 | hNav1.7 | Light chain variable region | H1 M839N | WO2014159595 SEQ ID NO: 16 | 8858 |
| MP389 | hNav1.7 | Light chain variable region | H1 M852N | WO2014159595 SEQ ID NO: 20 | 8869 |
| MP390 | hNav1.7 | Light chain variable region | H1 M875N | WO2014159595 SEQ ID NO: 24 | 8879 |
| MP391 | hNav1.7 | Light chain variable region | H1 M879N | WO2014159595 SEQ ID NO: 799 | 9014 |
| MP392 | hNav1.7 | Light chain variable region | H1 M994N | WO2014159595 SEQ ID NO: 815 | 9017 |
| MP393 | hNav1.7 | Light chain variable region | H1H1002B | WO2014159595 SEQ ID NO: 548 | 8935 |
| MP394 | hNav1.7 | Light chain variable region | H1H1003B | WO2014159595 SEQ ID NO: 100 | 8842 |
| MP395 | hNav1.7 | Light chain variable region | H1H1005B | WO2014159595 SEQ ID NO: 550 | 8936 |
| MP396 | hNav1.7 | Light chain variable region | H1H1006B | WO2014159595 SEQ ID NO: 104 | 8843 |
| MP397 | hNav1.7 | Light chain variable region | H1H1008B | WO2014159595 SEQ ID NO: 108 | 8844 |
| MP398 | hNav1.7 | Light chain variable region | H1H1009B | WO2014159595 SEQ ID NO: 552 | 8937 |
| MP399 | hNav1.7 | Light chain variable region | H1H1010B | WO2014159595 SEQ ID NO: 116 | 8846 |
| MP400 | hNav1.7 | Light chain variable region | H1H1011B | WO2014159595 SEQ ID NO: 120 | 8848 |
| MP401 | hNav1.7 | Light chain variable region | H1H1013B | WO2014159595 SEQ ID NO: 124 | 8849 |
| MP402 | hNav1.7 | Light chain variable region | H1H1015B | WO2014159595 SEQ ID NO: 128 | 8850 |
| MP403 | hNav1.7 | Light chain variable region | H1H1016B | WO2014159595 SEQ ID NO: 554 | 8938 |
| MP404 | hNav1.7 | Light chain variable region | H1H1019B | WO2014159595 SEQ ID NO: 112 | 8845 |
| MP405 | hNav1.7 | Light chain variable region | H1H1020B | WO2014159595 SEQ ID NO: 556 | 8939 |

TABLE 10-continued

Migraine and Pain Antibodies

| Antibody No. | Target | Description | Antibody Name | Reference Information | SEQ ID NO |
|---|---|---|---|---|---|
| MP406 | hNav1.7 | Light chain variable region | H1H1022B | WO2014159595 SEQ ID NO: 132 | 8851 |
| MP407 | hNav1.7 | Light chain variable region | H1H1023B | WO2014159595 SEQ ID NO: 136 | 8852 |
| MP408 | hNav1.7 | Light chain variable region | H1H1024B | WO2014159595 SEQ ID NO: 558 | 8940 |
| MP409 | hNav1.7 | Light chain variable region | H1H1025B | WO2014159595 SEQ ID NO: 560 | 8942 |
| MP410 | hNav1.7 | Light chain variable region | H1H1026B | WO2014159595 SEQ ID NO: 140 | 8853 |
| MP411 | hNav1.7 | Light chain variable region | H1H1030B | WO2014159595 SEQ ID NO: 144 | 8854 |
| MP412 | hNav1.7 | Light chain variable region | H1H1032B | WO2014159595 SEQ ID NO: 148 | 8855 |
| MP413 | hNav1.7 | Light chain variable region | H1H1034B | WO2014159595 SEQ ID NO: 562 | 8943 |
| MP414 | hNav1.7 | Light chain variable region | H1H1035B | WO2014159595 SEQ ID NO: 564 | 8944 |
| MP415 | hNav1.7 | Light chain variable region | H1H1038B | WO2014159595 SEQ ID NO: 152 | 8856 |
| MP416 | hNav1.7 | Light chain variable region | H1H1041B | WO2014159595 SEQ ID NO: 156 | 8857 |
| MP417 | hNav1.7 | Light chain variable region | H1H1044B | WO2014159595 SEQ ID NO: 160 | 8859 |
| MP418 | hNav1.7 | Light chain variable region | H1H1045B | WO2014159595 SEQ ID NO: 164 | 8860 |
| MP419 | hNav1.7 | Light chain variable region | H1H1048B | WO2014159595 SEQ ID NO: 566 | 8945 |
| MP420 | hNav1.7 | Light chain variable region | H1H1049B | WO2014159595 SEQ ID NO: 568 | 8946 |
| MP421 | hNav1.7 | Light chain variable region | H1H1050B | WO2014159595 SEQ ID NO: 168 | 8861 |
| MP422 | hNav1.7 | Light chain variable region | H1H1051B | WO2014159595 SEQ ID NO: 570 | 8947 |
| MP423 | hNav1.7 | Light chain variable region | H1H1055B | WO2014159595 SEQ ID NO: 172 | 8862 |
| MP424 | hNav1.7 | Light chain variable region | H1H1056B | WO2014159595 SEQ ID NO: 176 | 8863 |
| MP425 | hNav1.7 | Light chain variable region | H1H1059B | WO2014159595 SEQ ID NO: 180 | 8864 |
| MP426 | hNav1.7 | Light chain variable region | H1H1060B | WO2014159595 SEQ ID NO: 184 | 8865 |
| MP427 | hNav1.7 | Light chain variable region | H1H1064B | WO2014159595 SEQ ID NO: 572 | 8948 |
| MP428 | hNav1.7 | Light chain variable region | H1H1071B | WO2014159595 SEQ ID NO: 574 | 8949 |
| MP429 | hNav1.7 | Light chain variable region | H1H1072B | WO2014159595 SEQ ID NO: 576 | 8950 |
| MP430 | hNav1.7 | Light chain variable region | H1H1077B | WO2014159595 SEQ ID NO: 578 | 8951 |
| MP431 | hNav1.7 | Light chain variable region | H1H1086B | WO2014159595 SEQ ID NO: 580 | 8952 |
| MP432 | hNav1.7 | Light chain variable region | H1H1096B | WO2014159595 SEQ ID NO: 582 | 8953 |
| MP433 | hNav1.7 | Light chain variable region | H1H1120B | WO2014159595 SEQ ID NO: 584 | 8954 |
| MP434 | hNav1.7 | Light chain variable region | H1H1128B | WO2014159595 SEQ ID NO: 586 | 8955 |
| MP435 | hNav1.7 | Light chain variable region | H1H1132B | WO2014159595 SEQ ID NO: 588 | 8956 |
| MP436 | hNav1.7 | Light chain variable region | H1H1142B | WO2014159595 SEQ ID NO: 590 | 8957 |
| MP437 | hNav1.7 | Light chain variable region | H1H1171B | WO2014159595 SEQ ID NO: 592 | 8958 |
| MP438 | hNav1.7 | Light chain variable region | H2M799N | WO2014159595 SEQ ID NO: 831 | 9018 |
| MP439 | hNav1.7 | Light chain variable region | H4H1003P | WO2014159595 SEQ ID NO: 862 | 9020 |
| MP440 | hNav1.7 | Light chain variable region | H4H1025P | WO2014159595 SEQ ID NO: 874 | 9023 |
| MP441 | hNav1.7 | Light chain variable region | H4H361 B | WO2014159595 SEQ ID NO: 236 | 8878 |
| MP442 | hNav1.7 | Light chain variable region | H4H362B | WO2014159595 SEQ ID NO: 32 | 8901 |

TABLE 10-continued

Migraine and Pain Antibodies

| Antibody No. | Target | Description | Antibody Name | Reference Information | SEQ ID NO |
|---|---|---|---|---|---|
| MP443 | hNav1.7 | Light chain variable region | H4H362P | WO2014159595 SEQ ID NO: 870 | 9022 |
| MP444 | hNav1.7 | Light chain variable region | H4H363B | WO2014159595 SEQ ID NO: 594 | 8959 |
| MP445 | hNav1.7 | Light chain variable region | H4H364B | WO2014159595 SEQ ID NO: 596 | 8960 |
| MP446 | hNav1.7 | Light chain variable region | H4H365B | WO2014159595 SEQ ID NO: 240 | 8880 |
| MP447 | hNav1.7 | Light chain variable region | H4H366B | WO2014159595 SEQ ID NO: 598 | 8961 |
| MP448 | hNav1.7 | Light chain variable region | H4H367B | WO2014159595 SEQ ID NO: 36 | 8912 |
| MP449 | hNav1.7 | Light chain variable region | H4H368B | WO2014159595 SEQ ID NO: 40 | 8924 |
| MP450 | hNav1.7 | Light chain variable region | H4H369B | WO2014159595 SEQ ID NO: 600 | 8963 |
| MP451 | hNav1.7 | Light chain variable region | H4H371 B | WO2014159595 SEQ ID NO: 244 | 8881 |
| MP452 | hNav1.7 | Light chain variable region | H4H372B | WO2014159595 SEQ ID NO: 248 | 8882 |
| MP453 | hNav1.7 | Light chain variable region | H4H373B | WO2014159595 SEQ ID NO: 252 | 8883 |
| MP454 | hNav1.7 | Light chain variable region | H4H374B | WO2014159595 SEQ ID NO: 602 | 8964 |
| MP455 | hNav1.7 | Light chain variable region | H4H375B | WO2014159595 SEQ ID NO: 604 | 8965 |
| MP456 | hNav1.7 | Light chain variable region | H4H376B | WO2014159595 SEQ ID NO: 606 | 8966 |
| MP457 | hNav1.7 | Light chain variable region | H4H377B | WO2014159595 SEQ ID NO: 608 | 8967 |
| MP458 | hNav1.7 | Light chain variable region | H4H379B | WO2014159595 SEQ ID NO: 256 | 8884 |
| MP459 | hNav1.7 | Light chain variable region | H4H380B | WO2014159595 SEQ ID NO: 610 | 8968 |
| MP460 | hNav1.7 | Light chain variable region | H4H381 B | WO2014159595 SEQ ID NO: 260 | 8885 |
| MP461 | hNav1.7 | Light chain variable region | H4H382B | WO2014159595 SEQ ID NO: 44 | 8932 |
| MP462 | hNav1.7 | Light chain variable region | H4H384B | WO2014159595 SEQ ID NO: 612 | 8969 |
| MP463 | hNav1.7 | Light chain variable region | H4H385B | WO2014159595 SEQ ID NO: 264 | 8886 |
| MP464 | hNav1.7 | Light chain variable region | H4H385B | WO2014159595 SEQ ID NO: 683 | 9000 |
| MP465 | hNav1.7 | Light chain variable region | H4H387B | WO2014159595 SEQ ID NO: 614 | 8970 |
| MP466 | hNav1.7 | Light chain variable region | H4H388B | WO2014159595 SEQ ID NO: 268 | 8887 |
| MP467 | hNav1.7 | Light chain variable region | H4H391B | WO2014159595 SEQ ID NO: 48 | 8933 |
| MP468 | hNav1.7 | Light chain variable region | H4H391P | WO2014159595 SEQ ID NO: 52 | 8934 |
| MP469 | hNav1.7 | Light chain variable region | H4H392B | WO2014159595 SEQ ID NO: 616 | 8971 |
| MP470 | hNav1.7 | Light chain variable region | H4H394B | WO2014159595 SEQ ID NO: 618 | 8972 |
| MP471 | hNav1.7 | Light chain variable region | H4H395B | WO2014159595 SEQ ID NO: 620 | 8973 |
| MP472 | hNav1.7 | Light chain variable region | H4H395B | WO2014159595 SEQ ID NO: 687 | 9001 |
| MP473 | hNav1.7 | Light chain variable region | H4H396B | WO2014159595 SEQ ID NO: 272 | 8888 |
| MP474 | hNav1.7 | Light chain variable region | H4H397B | WO2014159595 SEQ ID NO: 56 | 8941 |
| MP475 | hNav1.7 | Light chain variable region | H4H398B | WO2014159595 SEQ ID NO: 276 | 8889 |
| MP476 | hNav1.7 | Light chain variable region | H4H399B | WO2014159595 SEQ ID NO: 280 | 8891 |
| MP477 | hNav1.7 | Light chain variable region | H4H400B | WO2014159595 SEQ ID NO: 284 | 8892 |
| MP478 | hNav1.7 | Light chain variable region | H4H402B | WO2014159595 SEQ ID NO: 288 | 8893 |
| MP479 | hNav1.7 | Light chain variable region | H4H404B | WO2014159595 SEQ ID NO: 622 | 8974 |

TABLE 10-continued

Migraine and Pain Antibodies

| Antibody No. | Target | Description | Antibody Name | Reference Information | SEQ ID NO |
|---|---|---|---|---|---|
| MP480 | hNav1.7 | Light chain variable region | H4H408B | WO2014159595 SEQ ID NO: 60 | 8962 |
| MP481 | hNav1.7 | Light chain variable region | H4H409B | WO2014159595 SEQ ID NO: 292 | 8894 |
| MP482 | hNav1.7 | Light chain variable region | H4H411B | WO2014159595 SEQ ID NO: 626 | 8976 |
| MP483 | hNav1.7 | Light chain variable region | H4H410B | WO2014159595 SEQ ID NO: 624 | 8975 |
| MP484 | hNav1.7 | Light chain variable region | H4H412B | WO2014159595 SEQ ID NO: 628 | 8977 |
| MP485 | hNav1.7 | Light chain variable region | H4H414B | WO2014159595 SEQ ID NO: 630 | 8978 |
| MP486 | hNav1.7 | Light chain variable region | H4H415B | WO2014159595 SEQ ID NO: 296 | 8895 |
| MP487 | hNav1.7 | Light chain variable region | H4H416B | WO2014159595 SEQ ID NO: 300 | 8896 |
| MP488 | hNav1.7 | Light chain variable region | H4H419B | WO2014159595 SEQ ID NO: 304 | 8897 |
| MP489 | hNav1.7 | Light chain variable region | H4H421B | WO2014159595 SEQ ID NO: 632 | 8979 |
| MP490 | hNav1.7 | Light chain variable region | H4H422B | WO2014159595 SEQ ID NO: 308 | 8898 |
| MP491 | hNav1.7 | Light chain variable region | H4H426B | WO2014159595 SEQ ID NO: 64 | 8983 |
| MP492 | hNav1.7 | Light chain variable region | H4H428B | WO2014159595 SEQ ID NO: 634 | 8980 |
| MP493 | hNav1.7 | Light chain variable region | H4H430B | WO2014159595 SEQ ID NO: 636 | 8981 |
| MP494 | hNav1.7 | Light chain variable region | H4H431B | WO2014159595 SEQ ID NO: 638 | 8982 |
| MP495 | hNav1.7 | Light chain variable region | H4H433B | WO2014159595 SEQ ID NO: 640 | 8984 |
| MP496 | hNav1.7 | Light chain variable region | H4H434B | WO2014159595 SEQ ID NO: 312 | 8899 |
| MP497 | hNav1.7 | Light chain variable region | H4H434B | WO2014159595 SEQ ID NO: 691 | 9002 |
| MP498 | hNav1.7 | Light chain variable region | H4H434P | WO2014159595 SEQ ID NO: 695 | 9003 |
| MP499 | hNav1.7 | Light chain variable region | H4H435B | WO2014159595 SEQ ID NO: 642 | 8985 |
| MP500 | hNav1.7 | Light chain variable region | H4H438B | WO2014159595 SEQ ID NO: 316 | 8900 |
| MP501 | hNav1.7 | Light chain variable region | H4H438B | WO2014159595 SEQ ID NO: 699 | 9004 |
| MP502 | hNav1.7 | Light chain variable region | H4H439B | WO2014159595 SEQ ID NO: 68 | 8999 |
| MP503 | hNav1.7 | Light chain variable region | H4H439P | WO2014159595 SEQ ID NO: 72 | 9008 |
| MP504 | hNav1.7 | Light chain variable region | H4H440B | WO2014159595 SEQ ID NO: 644 | 8986 |
| MP505 | hNav1.7 | Light chain variable region | H4H441B | WO2014159595 SEQ ID NO: 646 | 8987 |
| MP506 | hNav1.7 | Light chain variable region | H4H441 B | WO2014159595 SEQ ID NO: 703 | 9005 |
| MP507 | hNav1.7 | Light chain variable region | H4H441 P | WO2014159595 SEQ ID NO: 866 | 9021 |
| MP508 | hNav1.7 | Light chain variable region | H4H442B | WO2014159595 SEQ ID NO: 320 | 8902 |
| MP509 | hNav1.7 | Light chain variable region | H4H443B | WO2014159595 SEQ ID NO: 76 | 9012 |
| MP510 | hNav1.7 | Light chain variable region | H4H444B | WO2014159595 SEQ ID NO: 324 | 8903 |
| MP511 | hNav1.7 | Light chain variable region | H4H446B | WO2014159595 SEQ ID NO: 328 | 8904 |
| MP512 | hNav1.7 | Light chain variable region | H4H448B | WO2014159595 SEQ ID NO: 80 | 9016 |
| MP513 | hNav1.7 | Light chain variable region | H4H450B | WO2014159595 SEQ ID NO: 648 | 8988 |
| MP514 | hNav1.7 | Light chain variable region | H4H451B | WO2014159595 SEQ ID NO: 650 | 8989 |
| MP515 | hNav1.7 | Light chain variable region | H4H452B | WO2014159595 SEQ ID NO: 652 | 8990 |
| MP516 | hNav1.7 | Light chain variable region | H4H455B | WO2014159595 SEQ ID NO: 654 | 8991 |

TABLE 10-continued

Migraine and Pain Antibodies

| Antibody No. | Target | Description | Antibody Name | Reference Information | SEQ ID NO |
|---|---|---|---|---|---|
| MP517 | hNav1.7 | Light chain variable region | H4H456B | WO2014159595 SEQ ID NO: 332 | 8905 |
| MP518 | hNav1.7 | Light chain variable region | H4H457B | WO2014159595 SEQ ID NO: 336 | 8906 |
| MP519 | hNav1.7 | Light chain variable region | H4H458B | WO2014159595 SEQ ID NO: 340 | 8907 |
| MP520 | hNav1.7 | Light chain variable region | H4H459B | WO2014159595 SEQ ID NO: 656 | 8992 |
| MP521 | hNav1.7 | Light chain variable region | H4H460B | WO2014159595 SEQ ID NO: 344 | 8908 |
| MP522 | hNav1.7 | Light chain variable region | H4H461 B | WO2014159595 SEQ ID NO: 348 | 8909 |
| MP523 | hNav1.7 | Light chain variable region | H4H462B | WO2014159595 SEQ ID NO: 352 | 8910 |
| MP524 | hNav1.7 | Light chain variable region | H4H463B | WO2014159595 SEQ ID NO: 356 | 8911 |
| MP525 | hNav1.7 | Light chain variable region | H4H464B | WO2014159595 SEQ ID NO: 360 | 8913 |
| MP526 | hNav1.7 | Light chain variable region | H4H465B | WO2014159595 SEQ ID NO: 364 | 8914 |
| MP527 | hNav1.7 | Light chain variable region | H4H466B | WO2014159595 SEQ ID NO: 368 | 8915 |
| MP528 | hNav1.7 | Light chain variable region | H4H467B | WO2014159595 SEQ ID NO: 372 | 8916 |
| MP529 | hNav1.7 | Light chain variable region | H4H468B | WO2014159595 SEQ ID NO: 84 | 9019 |
| MP530 | hNav1.7 | Light chain variable region | H4H468P | WO2014159595 SEQ ID NO: 88 | 9024 |
| MP531 | hNav1.7 | Light chain variable region | H4H469B | WO2014159595 SEQ ID NO: 658 | 8993 |
| MP532 | hNav1.7 | Light chain variable region | H4H470B | WO2014159595 SEQ ID NO: 660 | 8994 |
| MP533 | hNav1.7 | Light chain variable region | H4H471B | WO2014159595 SEQ ID NO: 92 | 9025 |
| MP534 | hNav1.7 | Light chain variable region | H4H471P | WO2014159595 SEQ ID NO: 96 | 9026 |
| MP535 | hNav1.7 | Light chain variable region | H4H472B | WO2014159595 SEQ ID NO: 376 | 8917 |
| MP536 | hNav1.7 | Light chain variable region | H4H473B | WO2014159595 SEQ ID NO: 380 | 8918 |
| MP537 | hNav1.7 | Light chain variable region | H4H474B | WO2014159595 SEQ ID NO: 662 | 8995 |
| MP538 | hNav1.7 | Light chain variable region | H4H475B | WO2014159595 SEQ ID NO: 384 | 8919 |
| MP539 | hNav1.7 | Light chain variable region | H4H476B | WO2014159595 SEQ ID NO: 664 | 8996 |
| MP540 | hNav1.7 | Light chain variable region | H4H477B | WO2014159595 SEQ ID NO: 388 | 8920 |
| MP541 | hNav1.7 | Light chain variable region | H4H479B | WO2014159595 SEQ ID NO: 666 | 8997 |
| MP542 | hNav1.7 | Light chain variable region | H4H480B | WO2014159595 SEQ ID NO: 392 | 8921 |
| MP543 | hNav1.7 | Light chain variable region | H4H481 B | WO2014159595 SEQ ID NO: 396 | 8922 |
| MP544 | hNav1.7 | Light chain variable region | H4H482B | WO2014159595 SEQ ID NO: 400 | 8925 |
| MP545 | hNav1.7 | Light chain variable region | H4H483B | WO2014159595 SEQ ID NO: 404 | 8926 |
| MP546 | hNav1.7 | Light chain variable region | H4H484B | WO2014159595 SEQ ID NO: 408 | 8927 |
| MP547 | hNav1.7 | Light chain variable region | H4H486B | WO2014159595 SEQ ID NO: 412 | 8928 |
| MP548 | hNav1.7 | Light chain variable region | H4H487B | WO2014159595 SEQ ID NO: 668 | 8998 |
| MP549 | hNav1.7 | Light chain variable region | H4H488B | WO2014159595 SEQ ID NO: 416 | 8929 |
| MP550 | hNav1.7 | Light chain variable region | H4H489B | WO2014159595 SEQ ID NO: 420 | 8930 |
| MP551 | hNav1.7 | Light chain variable region | H4H491B | WO2014159595 SEQ ID NO: 424 | 8931 |
| MP552 | TNF | Light chain variable region | | US20030157061 SEQ ID NO: 4 | 9288 |
| MP553 | TrkA | Light chain variable region | 3-23*01 | WO2009098238 SEQ ID NO: 19 | 4233 |

TABLE 10-continued

Migraine and Pain Antibodies

| Antibody No. | Target | Description | Antibody Name | Reference Information | SEQ ID NO |
|---|---|---|---|---|---|
| MP554 | TrkA | Light chain variable region | BXhVH5VL1 N297A i | WO2009098238 SEQ ID NO: 23 | 4237 |
| MP555 | TrkA | Light chain variable region | HuVLWO | WQ2009098238 SEQ ID NO: 18 | 4232 |
| MP556 | TrkA | Light chain variable region | JH4 | WO2009098238 SEQ ID NO: 20 | 4234 |
| MP557 | TrkA | Light chain variable region | JK1 | WO2009098238 SEQ ID NO: 22 | 4236 |
| MP558 | TrkA | Light chain variable region | L6*01 | WO2009098238 SEQ ID NO: 21 | 4235 |
| MP559 | NGF | Light chain variable region, Antibody for chronic pain | Fasinumab, REGN475, SAR164877 | U.S. Pat. No. 7,988,967 SEQ ID NO: 110; U.S. Pat. No. 7,988,967 SEQ ID NO: 92 | 17750 |
| MP560 | NGF | Light chain, Antibody for chronic pain | Fulranumab, 4D4, AMG-403, JNJ-42160443 | U.S. Pat. No. 7,601,818 SEQ ID NO: 44; U.S. Pat. No. 8,552,157 SEQ ID NO: 17; U.S. Pat. No. 8,048,421 SEQ ID NO: 84 | 17751 |
| MP561 | NGF | Light chain, Antibody for chronic pain | Fasinumab, REGN475, SAR164877 | | 17752 |
| MP562 | NGF | Light chain, Antibody for pain, chronic and acute, osteoarthritis | Tanezumab, PF-04383119, RN624, E3 | US20040237124 SEQ ID NO: 2 | 17753 |
| MP563 | CGRP | Variable Heavy Domain | G1, cluster headache | U.S. Pat. No. 9,115,194 SEQ ID NO: 1 | 17754 |
| MP564 | CGRP | Variable Light Domain | G1, cluster headache | U.S. Pat. No. 9,115,194 SEQ ID NO: 2 | 17755 |

Ocular Disease Antibodies

In one embodiment the payload region of the AAV particle comprises one or more nucleic acid sequences encoding one or more of the ocular disease payload antibody polypeptides listed in Table 11 (OC1-00676; SEQ ID NO: 3124-3125, 3164-3177, 3329-3330, 3358-3371, 4308, 4323, 4420, 4431, 4680-4682, 4685-4728, 4735-4772, 47794781, 4783, 6792-6919, 7022-7024, 7271-7274, 7389-7392, 7396-7439, 74467496, 7503-7505, 9142-9255, 9257-9269, 9350, 9466-9468, 9617-9624, 9630-9633, 9655-9677 17666-17670, 17672-17680, 17723-17736, 17756-17875)

TABLE 11

Ocular Disease Antibodies

| Antibody No. | Target | Description | Antibody Name | Reference Information | SEQ ID NO |
|---|---|---|---|---|---|
| OC1 | VEGF-A | Fab-12 1cz8_L, Fab-12 variant Y0317/L-KAPPA (V-KAPPA(1-107) + C-KAPPA(108-213) | Ranibizumab, Lucentis | Lien and Lowman, In: Chemajovsky, 2008, Therapeutic Antibodies. Handbook of Experimental Pharmacology 181, Springer-Verlag, Berlin Heidelberg 131-150 | 17756 |
| OC2 | VEGF-A | Fab-12 variant Y031/Fab-12 variant Y0317 and VH-CH1 (VH(1-123) + CH1(124-215) | Ranibizumab, Lucentis | Lien and Lowman, In: Chemajovsky, 2008, Therapeutic Antibodies. Handbook of Experimental Pharmacology 181, Springer-Verlag, Berlin Heidelberg 131-150 | 17757 |
| OC3 | VEGF-A | Fab-12 variant Y0317/L-K APPA (V-KAPPA(1- | Ranibizumab, Lucentis | Lien and Lowman, In: Chemajovsky, 2008, Therapeutic Antibodies. Handbook of Experimental Pharmacology 181, | 17758 |

TABLE 11-continued

Ocular Disease Antibodies

| Antibody No. | Target | Description | Antibody Name | Reference Information | SEQ ID NO |
|---|---|---|---|---|---|
| | | 107) + C-KAPPA(108-213) | | Springer-Verlag, Berlin Heidelberg 131-150 | |
| OC4 | VEGF-A | Fab-12 variant Y0317/VH-CH1 (VH(1-123) + CH1(124-215) | Ranibizumab, Lucentis | Lien and Lowman, In: Chernajovsky, 2008, Therapeutic Antibodies. Handbook of Experimental Pharmacology 181, Springer-Verlag, Berlin Heidelberg 131-150 | 17759 |
| OC5 | | Fusion protein | Aflibercept fusion protein | | 17760 |
| OC6 | | Fusion protein | Conbercept fusion protein | | 17761 |
| OC7 | Annexin IV or a phospholipid; and (b) a complement inhibitor | Heavy chain | B4 | WO2014116880 SEQ ID NO: 15 | 4680 |
| OC8 | Annexin IV or a phospholipid; and (b) a complement inhibitor | Heavy chain | B4 | WO2014116880 SEQ ID NO: 16 | 4681 |
| OC9 | Annexin IV or a phospholipid; and (b) a complement inhibitor | Heavy chain | C2 | WO2014116880 SEQ ID NO: 36 | 4682 |
| OC10 | C3b | Heavy chain | rhuMAB 4D5-8 | U.S. Pat. No. 8,377,437 SEQ ID NO: 14 | 4685 |
| OC11 | C3b, Properdin (factor P), Factors Ba and Bb, C5, C6, C7, C8, C9 | Heavy chain | H-6 | WO2015099838 SEQ ID NO: 49 | 4716 |
| OC12 | C3b, Properdin (factor P), Factors Ba and Bb, C5, C6, C7, C8, C9 | Heavy chain | H-7 | WO2015099838 SEQ ID NO: 50 | 4717 |
| OC13 | C3b, Properdin (factor P), Factors Ba and Bb, C5, C6, C7, C8. C9 | Heavy chain | H-8 | WO2015099838 SEQ ID NO: 51 | 4718 |
| OC14 | C3b, Properdin (factor P), Factors Ba and Bb, C5, C6, C7, C8, C9 | Heavy chain | H-9 | WO2015099838 SEQ ID NO: 52 | 4719 |
| OC15 | C3b, Properdin (factor P), Factors Ba and Bb, C5, C6, C7, C8, C9 | Heavy chain | H-10 | WO2015099838 SEQ ID NO: 53 | 4720 |
| OC16 | C3b, Properdin (factor P), Factors Ba and Bb, C5, C6, C7, C8, C9 | Heavy chain | H-11 | WO2015099838 SEQ ID NO: 54 | 4721 |
| OC17 | C3b, Properdin (factor P), Factors Ba and Bb, C5, C6, C7, C8, C9 | Heavy chain | H-12 | WO2015099838 SEQ ID NO: 55 | 4722 |
| OC18 | C3b, Properdin (factor P), Factors Ba and Bb, C5, C6, C7, C8, C9 | Heavy chain | H-13 | WO2015099838 SEQ ID NO: 56 | 4723 |
| OC19 | C3b, Properdin (factor P), Factors Ba and Bb, C5, C6, C7, C8, C9 | Heavy chain | H-14 | WO2015099838 SEQ ID NO: 57 | 4724 |

TABLE 11-continued

Ocular Disease Antibodies

| Antibody No. | Target | Description | Antibody Name | Reference Information | SEQ ID NO |
|---|---|---|---|---|---|
| OC20 | C3b, Properdin (factor P), Factors Ba and Bb, C5, C6, C7, C8, C9 | Heavy chain | H-15 | WO2015099838 SEQ ID NO: 58 | 4725 |
| OC21 | C3b, Properdin (factor P), Factors Ba and Bb, C5, C6, C7, C8, C9 | Heavy chain | H-16 | WO2015099838 SEQ ID NO: 59 | 4726 |
| OC22 | C3b, Properdin (factor P), Factors Ba and Bb, C5, C6, C7, C8, C9 | Heavy chain | H-17 | WO2015099838 SEQ ID NO: 60 | 4727 |
| OC23 | C3b, Properdin (factor P), Factors Ba and Bb, C5, C6, C7, C8, C9 | Heavy chain | H-18 | WO2015099838 SEQ ID NO: 61 | 4728 |
| OC24 | C3b, Properdin (factor P), Factors Ba and Bb, C5, C6, C7, C8, C9 | Heavy chain | H-19 | WO2015099838 SEQ ID NO: 62 | 4686 |
| OC25 | C3b, Properdin (factor P), Factors Ba and Bb, C5, C6, C7, C8, C9 | Heavy chain | H-20 | WO2015099838 SEQ ID NO: 63 | 4687 |
| OC26 | C3b, Properdin (factor P), Factors Ba and Bb, C5, C6, C7, C8, C9 | Heavy chain | H-21 | WO2015099838 SEQ ID NO: 64 | 4688 |
| OC27 | C3b, Properdin (factor P), Factors Ba and Bb, C5, C6, C7, C8, C9 | Heavy chain | H-22 | WO2015099838 SEQ ID NO: 65 | 4689 |
| OC28 | C3b, Properdin (factor P), Factors Ba and Bb, C5, C6, C7, C8, C9 | Heavy chain | H-23 | WO2015099838 SEQ ID NO: 66 | 4690 |
| OC29 | C3b, Properdin (factor P), Factors Ba and Bb, C5, C6, C7, C8, C9 | Heavy chain | H-24 | WO2015099838 SEQ ID NO: 67 | 4691 |
| OC30 | C3b, Properdin (factor P), Factors Ba and Bb, C5, C6, C7, C8, C9 | Heavy chain | H-25 | WO2015099838 SEQ ID NO: 68 | 4692 |
| OC31 | C3b, Properdin (factor P), Factors Ba and Bb, C5, C6, C7, C8, C9 | Heavy chain | H-26 | WO2015099838 SEQ ID NO: 69 | 4693 |
| OC32 | C3b, Properdin (factor P), Factors Ba and Bb, C5, C6, C7, C8, C9 | Heavy chain | H-27 | WO2015099838 SEQ ID NO: 70 | 4694 |
| OC33 | C3b, Properdin (factor P), Factors Ba and Bb, C5, C6, C7, C8, C9 | Heavy chain | H-28 | WO2015099838 SEQ ID NO: 71 | 4695 |
| OC34 | C3b, Properdin (factor P), Factors Ba and Bb, C5, C6, C7, C8, C9 | Heavy chain | H-29 | WO2015099838 SEQ ID NO: 72 | 4696 |

TABLE 11-continued

Ocular Disease Antibodies

| Antibody No. | Target | Description | Antibody Name | Reference Information | SEQ ID NO |
|---|---|---|---|---|---|
| OC35 | C3b, Properdin (factor P), Factors Ba and Bb, C5, C6, C7, C8, C9 | Heavy chain | H-30 | WO2015099838 SEQ ID NO: 73 | 4697 |
| OC36 | C3b, Properdin (factor P), Factors Ba and Bb, C5, C6, C7, C8, C9 | Heavy chain | H-31 | WO2015099838 SEQ ID NO: 74 | 4698 |
| OC37 | C3b, Properdin (factor P), Factors Ba and Bb, C5, C6, C7, C8, C9 | Heavy chain | H-32 | WO2015099838 SEQ ID NO: 75 | 4699 |
| OC38 | C3b, Properdin (factor P), Factors Ba and Bb, C5, C6, C7, C8, C9 | Heavy chain | H-33 | WO2015099838 SEQ ID NO: 76 | 4700 |
| OC39 | C3b, Properdin (factor P), Factors Ba and Bb, C5, C6, C7, C8, C9 | Heavy chain | H-34 | WO2015099838 SEQ ID NO: 77 | 4701 |
| OC40 | C3b, Properdin (factor P), Factors Ba and Bb, C5, C6, C7, C8, C9 | Heavy chain | H-35 | WO2015099838 SEQ ID NO: 78 | 4702 |
| OC41 | C3b, Properdin (factor P), Factors Ba and Bb, C5, C6, C7, C8, C9 | Heavy chain | H-36 | WO2015099838 SEQ ID NO: 79 | 4703 |
| OC42 | C3b, Properdin (factor P), Factors Ba and Bb, C5, C6, C7, C8, C9 | Heavy chain | H-37 | WO2015099838 SEQ ID NO: 80 | 4704 |
| OC43 | C3b, Properdin (factor P), Factors Ba and Bb, C5, C6, C7, C8, C9 | Heavy chain | H-38 | WO2015099838 SEQ ID NO: 81 | 4705 |
| OC44 | C3b, Properdin (factor P), Factors Ba and Bb, C5, C6, C7, C8, C9 | Heavy chain | H-39 | WO2015099838 SEQ ID NO: 82 | 4706 |
| OC45 | C3b, Properdin (factor P), Factors Ba and Bb, C5, C6, C7, C8, C9 | Heavy chain | H-40 | WO2015099838 SEQ ID NO: 83 | 4707 |
| OC46 | C3b, Properdin (factor P), Factors Ba and Bb, C5, C6, C7, C8, C9 | Heavy chain | H-41 | WO2015099838 SEQ ID NO: 84 | 4708 |
| OC47 | C3b, Properdin (factor P), Factors Ba and Bb, C5, C6, C7, C8, C9 | Heavy chain | H-42 | WO2015099838 SEQ ID NO: 85 | 4709 |
| OC48 | C3b, Properdin (factor P), Factors Ba and Bb, C5, C6, C7, C8, C9 | Heavy chain | H-43 | WO2015099838 SEQ ID NO: 86 | 4710 |
| OC49 | C3b, Properdin (factor P), Factors Ba and Bb, C5, C6, C7, C8, C9 | Heavy chain | H-1 | WO2015099838 SEQ ID NO: 44 | 4711 |

TABLE 11-continued

Ocular Disease Antibodies

| Antibody No. | Target | Description | Antibody Name | Reference Information | SEQ ID NO |
|---|---|---|---|---|---|
| OC50 | C3b, Properdin (factor P), Factors Ba and Bb, C5, C6, C7, C8, C9 | Heavy chain | H-2 | WO2015099838 SEQ ID NO: 45 | 4712 |
| OC51 | C3b, Properdin (factor P), Factors Ba and Bb, C5, C6, C7, C8, C9 | Heavy chain | H-3 | WO2015099838 SEQ ID NO: 46 | 4713 |
| OC52 | C3b, Properdin (factor P), Factors Ba and Bb, C5, C6, C7, C8, C9 | Heavy chain | H-4 | WO2015099838 SEQ ID NO: 47 | 4714 |
| OC53 | C3b, Properdin (factor P), Factors Ba and Bb, C5, C6, C7, C8, C9 | Heavy chain | H-5 | WO2015099838 SEQ ID NO: 48 | 4715 |
| OC54 | C5 | Heavy chain | NVS808 | US20150158936 SEQ ID NO: 107 | 4735 |
| OC55 | C5 | Heavy chain | NVS806 | US20150158936 SEQ ID NO: 121 | 4736 |
| OC56 | C5 | Heavy chain | NVS804 | US20150158936 SEQ ID NO: 135 | 4737 |
| OC57 | C5 | Heavy chain | NVS809 | US20150158936 SEQ ID NO: 149 | 4738 |
| OC58 | C5 | Heavy chain | NVS805 | US20150158936 SEQ ID NO: 163 | 4739 |
| OC59 | C5 | Heavy chain | NVS962-S | US20150158936 SEQ ID NO: 177 | 4740 |
| OC60 | C5 | Heavy chain | NVS962-Q | US20150158936 SEQ ID NO: 191 | 4741 |
| OC61 | C5 | Heavy chain | NVS962-S31A | US20150158936 SEQ ID NO: 205 | 4742 |
| OC62 | C5 | Heavy chain | NVS962-G | US20150158936 SEQ ID NO: 219 | 4743 |
| OC63 | C5 | Heavy chain | NVS963 | US20150158936 SEQ ID NO: 23 | 4744 |
| OC64 | C5 | Heavy chain | NVS962-T | US20150158936 SEQ ID NO: 233 | 4745 |
| OC65 | C5 | Heavy chain | NVS965-T | US20150158936 SEQ ID NO: 247 | 4746 |
| OC66 | C5 | Heavy chain | NVS965-Q | US20150158936 SEQ ID NO: 261 | 4747 |
| OC67 | C5 | Heavy chain | NVS965-S | US20150158936 SEQ ID NO: 275 | 4748 |
| OC68 | C5 | Heavy chain | NVS964 | US20150158936 SEQ ID NO: 37 | 4749 |
| OC69 | C5 | Heavy chain | Antibody 8109 | US20150158936 SEQ ID NO: 418 | 4750 |
| OC70 | C5 | Heavy chain | Antibody 8110 | US20150158936 SEQ ID NO: 434 | 4751 |
| OC71 | C5 | Heavy chain | Antibody 8111 | US20150158936 SEQ ID NO: 449 | 4752 |
| OC72 | C5 | Heavy chain | Antibody 8113 | US20150158936 SEQ ID NO: 462 | 4753 |
| OC73 | C5 | Heavy chain | Antibody 8114 | US20150158936 SEQ ID NO: 478 | 4754 |
| OC74 | C5 | Heavy chain | NVS966 | US20150158936 SEQ ID NO: 51 | 4755 |
| OC75 | C5 | Heavy chain | NVS965 | US20150158936 SEQ ID NO: 65 | 4756 |
| OC76 | C5 | Heavy chain | NVS967 | US20150158936 SEQ ID NO: 79 | 4757 |
| OC77 | C5 | Heavy chain | NVS962 | US20150158936 SEQ ID NO: 9 | 4758 |
| OC78 | C5 | Heavy chain | NVS807 | US20150158936 SEQ ID NO: 93 | 4759 |
| OC79 | C5 | Heavy chain | H5 | US20150239966 SEQ ID NO: 10 | 4760 |
| OC80 | C5 | Heavy chain | H6 | US20150239966 SEQ ID NO: 12 | 4761 |

TABLE 11-continued

Ocular Disease Antibodies

| Antibody No. | Target | Description | Antibody Name | Reference Information | SEQ ID NO |
|---|---|---|---|---|---|
| OC81 | C5 | Heavy chain | H1 | US20150239966 SEQ ID NO: 2 | 4762 |
| OC82 | C5 | Heavy chain | H2 | US20150239966 SEQ ID NO: 4 | 4763 |
| OC83 | C5 | Heavy chain | H3 | US20150239966 SEQ ID NO: 6 | 4764 |
| OC84 | C5 | Heavy chain | H4 | US20150239966 SEQ ID NO: 8 | 4765 |
| OC85 | C5 | Heavy chain | Tesidolumab, "LFG 316, LFG-316, LFG316" | U.S. Pat. No. 8,241,628 SEQ ID NO: 9 | 4766 |
| OC86 | C5 | Heavy chain | | U.S. Pat. No. 9,133,269 SEQ ID NO: 1 | 4767 |
| OC87 | C5 | Heavy chain | | U.S. Pat. No. 9,133,269 SEQ ID NO: 2 | 4768 |
| OC88 | C5 | Heavy chain | | U.S. Pat. No. 9,133,269 SEQ ID NO: 27 | 4769 |
| OC89 | C5 | Heavy chain | | U.S. Pat. No. 9,133,269 SEQ ID NO: 3 | 4770 |
| OC90 | C5 | Heavy chain | | U.S. Pat. No. 9,133,269 SEQ ID NO: 4 | 4771 |
| OC91 | C5 | Heavy chain | | U.S. Pat. No. 9,133,269 SEQ ID NO: 5 | 4772 |
| OC92 | C5a | Heavy chain | BNJ364 | US20130224187 SEQ ID NO: 25 | 4779 |
| OC93 | C5a | Heavy chain | BNJ367, BNJ371, BNJ378 | US20130224187 SEQ ID NO: 33 | 4780 |
| OC94 | C5a | Heavy chain | BNJ366 | US20130224187 SEQ ID NO: 44 | 4781 |
| OC95 | CA 125 (MUC16) | Heavy chain | Sofituzumab vedotin, DMUC5754A (conjugate), MMUC1206A (nonconjugate) | U.S. Pat. No. 7,723,485 SEQ ID NO: 1 | 4783 |
| OC96 | CGRP | Heavy chain | Ab4 | US20120294802 SEQ ID NO: 34 | 17675 |
| OC97 | CGRP | Heavy chain | Ab1 | US20120294802 SEQ ID NO: 4 | 17666 |
| OC98 | CGRP | Heavy chain | Ab5 | US20120294802 SEQ ID NO: 44 | 17676 |
| OC99 | CGRP | Heavy chain | Ab6 | US20120294802 SEQ ID NO: 54 | 17677 |
| OC100 | CGRP | Heavy chain | Ab7 | US20120294802 SEQ ID NO: 64 | 17678 |
| OC101 | CGRP | Heavy chain | Ab8 | US20120294802 SEQ ID NO: 74 | 17679 |
| OC102 | CGRP | Heavy chain | Ab9 | US20120294802 SEQ ID NO: 84 | 17680 |
| OC103 | CGRP | Heavy chain | Ab10 | US20120294802 SEQ ID NO: 94 | 17667 |
| OC104 | CGRP | Heavy chain | Ab11 | US20120294802 SEQ ID NO: 104 | 17668 |
| OC105 | CGRP | Heavy chain | Ab12 | US20120294802 SEQ ID NO: 114 | 17669 |
| OC106 | CGRP | Heavy chain | Ab13 | US20120294802 SEQ ID NO: 124 | 17670 |
| OC107 | CGRP | Heavy chain | Ab14 | US20120294802 SEQ ID NO: 134 | 17672 |
| OC108 | CGRP | Heavy chain | Ab2 | US20120294802 SEQ ID NO: 14 | 17673 |
| OC109 | CGRP | Heavy chain | Ab3 | US20120294802 SEQ ID NO: 24 | 17674 |
| OC110 | Factor D | Heavy chain | Fab 238 | WO2009134711 SEQ ID NO: 52 | 17762 |
| OC111 | Factor D, humanized IgG1 | Heavy Chain | Lampalizumab, | U.S. Pat. No. 8,273,352 SEQ ID NO: 62 | 17763 |
| OC112 | platelet-derived growth factor receptor beta PDGFRB | Heavy chain | Rinucumab, REGN2176 | | 17764 |

TABLE 11-continued

Ocular Disease Antibodies

| Antibody No. | Target | Description | Antibody Name | Reference Information | SEQ ID NO |
|---|---|---|---|---|---|
| OC113 | S1P4 | Heavy chain | | WO2015057939 SEQ ID NO: 39 | 4308 |
| OC114 | VEGF, C5, Factor P, Factor D, EPO, EPOR, IL-1β, IL-17A, Il-10, TNFα, or FGFR2 | Heavy chain | NVS73 | US20140186350 SEQ ID 113 | 17765 |
| OC115 | VEGF, C5, Factor P, Factor D, EPO, EPOR, IL-1β, IL-17A, Il-10, TNFα, or FGFR2 | Heavy chain | NVS73T | US20140186350 SEQ ID 115 | 17766 |
| OC116 | VEGF, C5, Factor P, Factor D, EPO, EPOR, IL-1β, IL-17A, Il-10, TNFα, or FGFR2 | Heavy chain | NVS75 | US20140186350 SEQ ID 194 | 17767 |
| OC117 | VEGF, C5, Factor P, Factor D, EPO, EPOR, IL-1β, IL-17A, Il-10, TNFα, or FGFR2 | Heavy chain | NVS74T, NCS75T | US20140186350 SEQ ID 196 | 17768 |
| OC118 | VEGF, C5, Factor P, Factor D, EPO, EPOR, IL-1β, IL-17A, Il-10, TNFα, or FGFR2 | Heavy chain | NVS1 | US20140186350 SEQ ID 21 | 17769 |
| OC119 | VEGF, C5, Factor P, Factor D, EPO, EPOR, IL-1β, IL-17A, Il-10, TNFα, or FGFR2 | Heavy chain | NVS2 | US20140186350 SEQ ID 23 | 17770 |
| OC120 | VEGF, C5, Factor P, Factor D, EPO, EPOR, IL-1β, IL-17A, Il-10, TNFα, or FGFR2 | Heavy chain | NVS3 | US20140186350 SEQ ID 25 | 17771 |
| OC121 | VEGF, C5, Factor P, Factor D, EPO, EPOR, IL-1β, IL-17A, Il-10, TNFα, or FGFR2 | Heavy chain | NVS36 | US20140186350 SEQ ID 27 | 17772 |
| OC122 | VEGF, C5, Factor P, Factor D, EPO, EPOR, IL-1β, IL-17A, Il-10, TNFα, or FGFR2 | Heavy chain | NVS37 | US20140186350 SEQ ID 29 | 17773 |
| OC123 | VEGF, C5, Factor P, Factor D, EPO, EPOR, IL-1β, IL-17A, Il-10, TNFα, or FGFR2 | Heavy chain | NVS70 | US20140186350 SEQ ID 42 | 17774 |
| OC124 | VEGF, C5, Factor P, Factor D, EPO, EPOR, IL-1β, IL-17A, Il-10, TNFα, or FGFR2 | Heavy chain | NVS70T | US20140186350 SEQ ID 44 | 17775 |
| OC125 | VEGF, C5, Factor P, Factor D, EPO, EPOR, IL-1β, IL-17A, Il-10, TNFα, or FGFR2 | Heavy chain | NVS71 | US20140186350 SEQ ID 61 | 17776 |

TABLE 11-continued

Ocular Disease Antibodies

| Antibody No. | Target | Description | Antibody Name | Reference Information | SEQ ID NO |
|---|---|---|---|---|---|
| OC126 | VEGF, C5, Factor P, Factor D, EPO, EPOR, IL-1β, IL-17A, Il-10, TNFα, or FGFR2 | Heavy chain | NVS71T | US20140186350 SEQ ID 63 | 17777 |
| OC127 | VEGF, C5, Factor P, Factor D, EPO, EPOR, IL-1β, IL-17A, Il-10, TNFα, or FGFR2 | Heavy chain | NVS72 | US20140186350 SEQ ID 83 | 17778 |
| OC128 | VEGF, C5, Factor P, Factor D, EPO, EPOR, IL-1β, IL-17A, Il-10, TNFα, or FGFR2 | Heavy chain | NVS72T | US20140186350 SEQ ID 85 | 17779 |
| OC129 | VEGF, C5, Factor P, Factor D, EPO, EPOR, IL-1β, IL-17A, Il-10, TNFα, or FGFR2 | Heavy chain | NVS4, NVS1j | US20140186350 SEQ ID 9 | 17780 |
| OC130 | VEGF, C5, Factor P, Factor D, EPO, EPOR, IL-1β, IL-17A, Il-10, TNFα, or FGFR2 | Heavy chain | NVS81 | US20140186350 SEQ ID 157 | 17781 |
| OC131 | VEGF, C5, Factor P, Factor D, EPO, EPOR, IL-1β, IL-17A, Il-10, TNFα, or FGFR2 | Heavy chain | NVS81T | US20140186350 SEQ ID 159 | 17782 |
| OC132 | VEGF, C5. Factor P, Factor D, EPO, EPOR, IL-1β, IL-17A, Il-10, TNFα, or FGFR2 | Heavy chain | NVS82 | US20140186350 SEQ ID 161 | 17783 |
| OC133 | VEGF, C5, Factor P, Factor D, EPO, EPOR, IL-1β, IL-17A, Il-10, TNFα, or FGFR2 | Heavy chain | NVS82T | US20140186350 SEQ ID 163 | 17784 |
| OC134 | VECF, C5, Factor P, Factor D, EPO, EPOR, IL-1β, IL-17A, Il-10, TNFα, or FGFR2 | Heavy chain | NVS1b | US20140186350 SEQ ID 171 | 17785 |
| OC135 | VEGF, C5, Factor P, Factor D, EPO, EPOR, IL-1β, IL-17A, Il-10, TNFα, or FGFR2 | Heavy chain | NVS1c | US20140186350 SEQ ID 173 | 17786 |
| OC136 | VEGF, C5, Factor P, Factor D, EPO, EPOR, IL-1β, IL-17A, Il-10, TNFα, or FGFR2 | Heavy chain | NVS1d | US20140186350 SEQ ID 175 | 17787 |
| OC137 | VEGF, C5, Factor P, Factor D, EPO, EPOR, IL-1β, IL-17A, Il-10, TNFα, or FGFR2 | Heavy chain | NVS1e | US20140186350 SEQ ID 177 | 17788 |
| OC138 | VEGF, C5, Factor P, Factor D, EPO, EPOR, | Heavy chain | NVS1f | US20140186350 SEQ ID 179 | 17789 |

TABLE 11-continued

Ocular Disease Antibodies

| Antibody No. | Target | Description | Antibody Name | Reference Information | SEQ ID NO |
|---|---|---|---|---|---|
| OC139 | IL-1β, IL-17A, Il-10, TNFα, or FGFR2 VEGF, C5, Factor P, Factor D, EPO, EPOR, IL-1β, IL-17A, Il-10, TNFα, or FGFR2 | Heavy chain | NVS1g | US20140186350 SEQ ID 181 | 17790 |
| OC140 | VEGF, C5, Factor P, Factor D, EPO, EPOR, IL-1β, IL-17A, Il-10, TNFα, or FGFR2 | Heavy chain | NVS1h | US20140186350 SEQ ID 183 | 17791 |
| OC141 | sphingosine-1-phosphate | Heavy chain full | Sonepcizumab, S1P-LT1011 | | 17792 |
| OC142 | sphingosine-1-phosphate | Heavy chain variable | Sonepcizumab, S1P-LT1009 | | 17793 |
| OC143 | Factor D | Heavy chain variable region | Fab 238 | WO2009134711 SEQ ID NO: 18 | 17794 |
| OC144 | Factor D | Heavy chain variable region | Fab 238-1 | WO2009134711 SEQ ID NO: 19 | 17795 |
| OC145 | Factor D | Heavy chain variable region | Humanized Clone #111 | WO2009134711 SEQ ID NO: 2 | 17796 |
| OC146 | Factor D | Heavy chain variable region | Fab 238-2 | WO2009134711 SEQ ID NO: 20 | 17797 |
| OC147 | Factor D | Heavy chain variable region | Fab 238-3 | WO2009134711 SEQ ID NO: 21 | 17798 |
| OC148 | Factor D | Heavy chain variable region | Fab 238-4 | WO2009134711 SEQ ID NO: 22 | 17799 |
| OC149 | Factor D | Heavy chain variable region | Fab 238-5 | WO2009134711 SEQ ID NO: 23 | 17800 |
| OC150 | Factor D | Heavy chain variable region | Fab 238-6 | WO2009134711 SEQ ID NO: 24 | 17801 |
| OC151 | Factor D | Heavy chain variable region | Fab 238-7 | WO2009134711 SEQ ID NO: 25 | 17802 |
| OC152 | Factor D | Heavy chain variable region | Fab 238-8 | WO2009134711 SEQ ID NO: 26 | 17803 |
| OC153 | Factor D | Heavy chain variable region | Fab 238-9 | WO2009134711 SEQ ID NO: 27 | 17804 |
| OC154 | Factor D | Heavy chain variable region | Fab 238-10 | WO2009134711 SEQ ID NO: 28 | 17805 |
| OC155 | Factor D | Heavy chain variable region | Fab 238-11 | WO2009134711 SEQ ID NO: 29 | 17806 |
| OC156 | Factor D | Heavy chain variable region | L243 | WO2009134711 SEQ ID NO: 34 | 17807 |
| OC157 | Factor D | Heavy chain variable region | humanized L243 | WO2009134711 SEQ ID NO: 38 | 17808 |
| OC158 | LPG (lysophosphatidylglucoside) | Heavy chain variable region | #7 | U.S. Pat. No. 8,591,902 SEQ ID NO: 18 | 3124 |
| OC159 | LPG (lysophosphatidylglucoside) | Heavy chain variable region | #15 | U.S. Pat. No. 8,591,902 SEQ ID NO: 8 | 3125 |
| OC160 | PDGFR-beta | Heavy chain variable region | 3373N | US20140193402 SEQ ID 114 | 6792 |
| OC161 | PDGFR-beta | Heavy chain variable region | 3374N | US20140193402 SEQ ID 130 | 6793 |
| OC162 | PDGFR-beta | Heavy chain variable region | 3094P | US20140193402 SEQ ID 146 | 6794 |
| OC163 | PDGFR-beta | Heavy chain variable region | 3095S | US20140193402 SEQ ID 162 | 6795 |
| OC164 | PDGFR-beta | Heavy chain variable region | 3096S | US20140193402 SEQ ID 178 | 6796 |
| OC165 | PDGFR-beta | Heavy chain variable region | 3305N | US20140193402 SEQ ID 18 | 6797 |
| OC166 | PDGFR-beta | Heavy chain variable region | 3097S | US20140193402 SEQ ID 194 | 6798 |
| OC167 | PDGFR-beta | Heavy chain variable region | 3299N | US20140193402 SEQ ID 2 | 6799 |
| OC168 | PDGFR-beta | Heavy chain variable region | 3098S | US20140193402 SEQ ID 210 | 6800 |
| OC169 | PDGFR-beta | Heavy chain variable region | 3099S | US20140193402 SEQ ID 226 | 6801 |

TABLE 11-continued

Ocular Disease Antibodies

| Antibody No. | Target | Description | Antibody Name | Reference Information | SEQ ID NO |
|---|---|---|---|---|---|
| OC170 | PDGFR-beta | Heavy chain variable region | 3102S | US20140193402 SEQ ID 242 | 6802 |
| OC171 | PDGFR-beta | Heavy chain variable region | 3103S | US20140193402 SEQ ID 258 | 6803 |
| OC172 | PDGFR-beta | Heavy chain variable region | 3104S | US20140193402 SEQ ID 274 | 6804 |
| OC173 | PDGFR-beta | Heavy chain variable region | 3105S | US20140193402 SEQ ID 290 | 6805 |
| OC174 | PDGFR-beta | Heavy chain variable region | 3106S | US20140193402 SEQ ID 306 | 6806 |
| OC175 | PDGFR-beta | Heavy chain variable region | 3107S | US20140193402 SEQ ID 322 | 6807 |
| OC176 | PDGFR-beta | Heavy chain variable region | 3310N | US20140193402 SEQ ID 34 | 6808 |
| OC177 | PDGFR-beta | Heavy chain variable region | 3361N | US20140193402 SEQ ID 50 | 6809 |
| OC178 | PDGFR-beta | Heavy chain variable region | 3363N | US20140193402 SEQ ID 66 | 6810 |
| OC179 | PDGFR-beta | Heavy chain variable region | 3365N | US20140193402 SEQ ID 82 | 6811 |
| OC180 | PDGFR-beta | Heavy chain variable region | 3368N | US20140193402 SEQ ID 98 | 6812 |
| OC181 | PDGFRβ/VEGF-A | Heavy chain variable region | Cluster # 1322 | US20110177074 SEQ ID NO: 100 | 6813 |
| OC182 | PDGFRβ/VEGF-A | Heavy chain variable region | Cluster # 1323 | US20110177074 SEQ ID NO: 104 | 6814 |
| OC183 | PDGFRβ/VEGF-A | Heavy chain variable region | Cluster # 1330 | US20110177074 SEQ ID NO: 108 | 6815 |
| OC184 | PDGFRβ/VEGF-A | Heavy chain variable region | Cluster # 1334 | US20110177074 SEQ ID NO: 112 | 6816 |
| OC185 | PDGFRβ/VEGF-A | Heavy chain variable region | Cluster # 1345 | US20110177074 SEQ ID NO: 116 | 6817 |
| OC186 | PDGFRβ/VEGF-A | Heavy chain variable region | Cluster # 600 | US20110177074 SEQ ID NO: 12 | 6818 |
| OC187 | PDGFRβ/VEGF-A | Heavy chain variable region | Cluster # 1346 | US20110177074 SEQ ID NO: 120 | 6819 |
| OC188 | PDGFRβ/VEGF-A | Heavy chain variable region | Cluster # 1359 | US20110177074 SEQ ID NO: 124 | 6820 |
| OC189 | PDGFRβ/VEGF-A | Heavy chain variable region | Cluster # 1365 | US20110177074 SEQ ID NO: 128 | 6821 |
| OC190 | PDGFRβ/VEGF-A | Heavy chain variable region | Cluster # 1402 | US20110177074 SEQ ID NO: 132 | 6822 |
| OC191 | PDGFRβ/VEGF-A | Heavy chain variable region | Cluster # 1515 | US20110177074 SEQ ID NO: 136 | 6823 |
| OC192 | PDGFRβ/VEGF-A | Heavy chain variable region | Cluster # 1531 | US20110177074 SEQ ID NO: 140 | 6824 |
| OC193 | PDGFRβ/VEGF-A | Heavy chain variable region | Cluster # 1535 | US20110177074 SEQ ID NO: 144 | 6825 |
| OC194 | PDGFRβ/VEGF-A | Heavy chain variable region | Cluster # 1541 | US20110177074 SEQ ID NO: 148 | 6826 |
| OC195 | PDGFRβ/VEGF-A | Heavy chain variable region | Cluster # 1550 | US20110177074 SEQ ID NO: 152 | 6827 |
| OC196 | PDGFRβ/VEGF-A | Heavy chain variable region | Cluster # 1564 | US20110177074 SEQ ID NO: 156 | 6828 |
| OC197 | PDGFRβ/VEGF-A | Heavy chain variable region | Cluster # 607 | US20110177074 SEQ ID NO: 16 | 6829 |
| OC198 | PDGFRβ/VEGF-A | Heavy chain variable region | Cluster # 1601 | US20110177074 SEQ ID NO: 160 | 6830 |
| OC199 | PDGFRβ/VEGF-A | Heavy chain variable region | Cluster # 1629 | US20110177074 SEQ ID NO: 164 | 6831 |
| OC200 | PDGFRβ/VEGF-A | Heavy chain variable region | Cluster # 635 | US20110177074 SEQ ID NO: 168 | 6832 |
| OC201 | PDGFRβ/VEGF-A | Heavy chain variable region | Cluster # 636 | US20110177074 SEQ ID NO: 172 | 6833 |
| OC202 | PDGFRβ/VEGF-A | Heavy chain variable region | Cluster # 638 | US20110177074 SEQ ID NO: 176 | 6834 |
| OC203 | PDGFRβ/VEGF-A | Heavy chain variable region | Cluster # 656 | US20110177074 SEQ ID NO: 180 | 6835 |
| OC204 | PDGFRβ/VEGF-A | Heavy chain variable region | Cluster # 665 | US20110177074 SEQ ID NO: 184 | 6836 |
| OC205 | PDGFRβ/VEGF-A | Heavy chain variable region | Cluster # 668 | US20110177074 SEQ ID NO: 188 | 6837 |
| OC206 | PDGFRβ/VEGF-A | Heavy drain variable region | Cluster # 669 | US20110177074 SEQ ID NO: 192 | 6838 |

TABLE 11-continued

Ocular Disease Antibodies

| Antibody No. | Target | Description | Antibody Name | Reference Information | SEQ ID NO |
|---|---|---|---|---|---|
| OC207 | PDGFRβ/VEGF-A | Heavy chain variable region | Cluster # 679 | US20110177074 SEQ ID NO: 196 | 6839 |
| OC208 | PDGFRβ/VEGF-A | Heavy chain variable region | Cluster # 613 | US20110177074 SEQ ID NO: 20 | 6840 |
| OC209 | PDGFRβ/VEGF-A | Heavy chain variable region | Cluster # 695 | US20110177074 SEQ ID NO: 200 | 6841 |
| OC210 | PDGFRβ/VEGF-A | Heavy chain variable region | Cluster # 709 | US20110177074 SEQ ID NO: 204 | 6842 |
| OC211 | PDGFRβ/VEGF-A | Heavy chain variable region | Cluster # 710 | US20110177074 SEQ ID NO: 208 | 6843 |
| OC212 | PDGFRβ/VEGF-A | Heavy chain variable region | Cluster # 741 | US20110177074 SEQ ID NO: 212 | 6844 |
| OC213 | PDGFRβ/VEGF-A | Heavy chain variable region | Cluster # 752 | US20110177074 SEQ ID NO: 216 | 6845 |
| OC214 | PDGFRβ/VEGF-A | Heavy chain variable region | Cluster # 772 | US20110177074 SEQ ID NO: 220 | 6846 |
| OC215 | PDGFRβ/VEGF-A | Heavy chain variable region | Cluster # 779 | US20110177074 SEQ ID NO: 224 | 6847 |
| OC216 | PDGFRβ/VEGF-A | Heavy chain variable region | Cluster # 799 | US20110177074 SEQ ID NO: 228 | 6848 |
| OC217 | PDGFRβ/VEGF-A | Heavy chain variable region | Cluster # 830 | US20110177074 SEQ ID NO: 232 | 6849 |
| OC218 | PDGFRβ/VEGF-A | Heavy chain variable region | Cluster # 844 | US20110177074 SEQ ID NO: 236 | 6850 |
| OC219 | PDGFRβ/VEGF-A | Heavy chain variable region | Cluster # 941 | US20110177074 SEQ ID NO: 24 | 6851 |
| OC220 | PDGFRβ/VEGF-A | Heavy chain variable region | Cluster # 847 | US20110177074 SEQ ID NO: 240 | 6852 |
| OC221 | PDGFRβ/VEGF-A | Heavy chain variable region | Cluster # 868 | US20110177074 SEQ ID NO: 244 | 6853 |
| OC222 | PDGFRβ/VEGF-A | Heavy chain variable region | Cluster # 870 | US20110177074 SEQ ID NO: 248 | 6854 |
| OC223 | PDGFRβ/VEGF-A | Heavy chain variable region | Cluster # 883 | US20110177074 SEQ ID NO: 252 | 6855 |
| OC224 | PDGFRβ/VEGF-A | Heavy chain variable region | Cluster # 887 | US20110177074 SEQ ID NO: 256 | 6856 |
| OC225 | PDGFRβ/VEGF-A | Heavy chain variable region | Cluster # 901 | US20110177074 SEQ ID NO: 260 | 6857 |
| OC226 | PDGFRβ/VEGF-A | Heavy chain variable region | Cluster # 905 | US20110177074 SEQ ID NO: 264 | 6858 |
| OC227 | PDGFRβ/VEGF-A | Heavy chain variable region | Cluster # 909 | US20110177074 SEQ ID NO: 268 | 6859 |
| OC228 | PDGFRβ/VEGF-A | Heavy chain variable region | Cluster # 928 | US20110177074 SEQ ID NO: 272 | 6860 |
| OC229 | PDGFRβ/VEGF-A | Heavy chain variable region | Cluster # 1036 | US20110177074 SEQ ID NO: 276 | 6861 |
| OC230 | PDGFRβ/VEGF-A | Heavy chain variable region | Cluster # 946 | US20110177074 SEQ ID NO: 28 | 6862 |
| OC231 | PDGFRβ/VEGF-A | Heavy chain variable region | Cluster # 1039 | US20110177074 SEQ ID NO: 280 | 6863 |
| OC232 | PDGFRβ/VEGF-A | Heavy chain variable region | Cluster # 1040 | US20110177074 SEQ ID NO: 284 | 6864 |
| OC233 | PDGFRβ/VEGF-A | Heavy chain variable region | Cluster # 1044 | US20110177074 SEQ ID NO: 288 | 6865 |
| OC234 | PDGFRβ/VEGF-A | Heavy chain variable region | Cluster # 1048 | US20110177074 SEQ ID NO: 292 | 6866 |
| OC235 | PDGFRβ/VEGF-A | Heavy chain variable region | Cluster # 1056 | US20110177074 SEQ ID NO: 296 | 6867 |
| OC236 | PDGFRβ/VEGF-A | Heavy chain variable region | Cluster # 1064 | US20110177074 SEQ ID NO: 300 | 6868 |
| OC237 | PDGFRβ/VEGF-A | Heavy chain variable region | Cluster # 1080 | US20110177074 SEQ ID NO: 304 | 6869 |
| OC238 | PDGFRβ/VEGF-A | Heavy chain variable region | Cluster # 1092 | US20110177074 SEQ ID NO: 308 | 6870 |
| OC239 | PDGFRβ/VEGF-A | Heavy chain variable region | Cluster # 1094 | US20110177074 SEQ ID NO: 312 | 6871 |
| OC240 | PDGFRβ/VEGF-A | Heavy chain variable region | Cluster # 1096 | US20110177074 SEQ ID NO: 316 | 6872 |
| OC241 | PDGFRβ/VEGF-A | Heavy chain variable region | Cluster # 947 | US20110177074 SEQ ID NO: 32 | 6873 |
| OC242 | PDGFRβ/VEGF-A | Heavy chain variable region | Cluster # 1107 | US20110177074 SEQ ID NO: 320 | 6874 |
| OC243 | PDGFRβ/VEGF-A | Heavy chain variable region | Cluster # 1111 | US20110177074 SEQ ID NO: 324 | 6875 |

TABLE 11-continued

Ocular Disease Antibodies

| Antibody No. | Target | Description | Antibody Name | Reference Information | SEQ ID NO |
|---|---|---|---|---|---|
| OC244 | PDGFRβ/VEGF-A | Heavy chain variable region | Cluster # 1123 | US20110177074 SEQ ID NO: 328 | 6876 |
| OC245 | PDGFRβ/VEGF-A | Heavy chain variable region | Cluster # 1135 | US20110177074 SEQ ID NO: 332 | 6877 |
| OC246 | PDGFRβ/VEGF-A | Heavy chain variable region | Cluster # 1142 | US20110177074 SEQ ID NO: 336 | 6878 |
| OC247 | PDGFRβ/VEGF-A | Heavy chain variable region | Cluster # 1155 | US20110177074 SEQ ID NO: 340 | 6879 |
| OC248 | PDGFRβ/VEGF-A | Heavy chain variable region | Cluster # 1250 | US20110177074 SEQ ID NO: 344 | 6880 |
| OC249 | PDGFRβ/VEGF-A | Heavy chain variable region | Cluster # 1252 | US20110177074 SEQ ID NO: 348 | 6881 |
| OC250 | PDGFRβ/VEGF-A | Heavy chain variable region | Cluster # 1254 | US20110177074 SEQ ID NO: 352 | 6882 |
| OC251 | PDGFRβ/VEGF-A | Heavy chain variable region | Cluster # 1257 | US20110177074 SEQ ID NO: 356 | 6883 |
| OC252 | PDGFRβ/VEGF-A | Heavy chain variable region | Cluster # 949 | US20110177074 SEQ ID NO: 36 | 6884 |
| OC253 | PDGFRβ/VEGF-A | Heavy chain variable region | Cluster # 1264 | US20110177074 SEQ ID NO: 360 | 6885 |
| OC254 | PDGFRβ/VEGF-A | Heavy chain variable region | Cluster # 1266 | US20110177074 SEQ ID NO: 364 | 6886 |
| OC255 | PDGFRβ/VEGF-A | Heavy chain variable region | Cluster # 1268 | US20110177074 SEQ ID NO: 368 | 6887 |
| OC256 | PDGFRβ/VEGF-A | Heavy chain variable region | Cluster # 1269 | US20110177074 SEQ ID NO: 372 | 6888 |
| OC257 | PDGFRβ/VEGF-A | Heavy chain variable region | Cluster # 1270 | US20110177074 SEQ ID NO: 376 | 6889 |
| OC258 | PDGFRβ/VEGF-A | Heavy chain variable region | Cluster # 1281 | US20110177074 SEQ ID NO: 380 | 6890 |
| OC259 | PDGFRβ/VEGF-A | Heavy chain variable region | Cluster # 1283 | US20110177074 SEQ ID NO: 384 | 6891 |
| OC260 | PDGFRβ/VEGF-A | Heavy chain variable region | Cluster # 1285 | US20110177074 SEQ ID NO: 388 | 6892 |
| OC261 | PDGFRβ/VEGF-A | Heavy chain variable region | Cluster # 1409 | US20110177074 SEQ ID NO: 392 | 6893 |
| OC262 | PDGFRβ/VEGF-A | Heavy chain variable region | Cluster # 1410 | US20110177074 SEQ ID NO: 396 | 6894 |
| OC263 | PDGFRβ/VEGF-A | Heavy chain variable region | Cluster # 975 | US20110177074 SEQ ID NO: 40 | 6895 |
| OC264 | PDGFRβ/VEGF-A | Heavy chain variable region | Cluster # 1413 | US20110177074 SEQ ID NO: 400 | 6896 |
| OC265 | PDGFRβ/VEGF-A | Heavy chain variable region | Cluster # 1416 | US20110177074 SEQ ID NO: 404 | 6897 |
| OC266 | PDGFRβ/VEGF-A | Heavy chain variable region | Cluster # 1420 | US20110177074 SEQ ID NO: 408 | 6898 |
| OC267 | PDGFRβ/VEGF-A | Heavy chain variable region | Cluster # 1428 | US20110177074 SEQ ID NO: 412 | 6899 |
| OC268 | PDGFRβ/VEGF-A | Heavy chain variable region | Cluster # 1437 | US20110177074 SEQ ID NO: 416 | 6900 |
| OC269 | PDGFRβ/VEGF-A | Heavy chain variable region | Cluster # 1449 | US20110177074 SEQ ID NO: 420 | 6901 |
| OC270 | PDGFRβ/VEGF-A | Heavy chain variable region | Cluster # 1458 | US20110177074 SEQ ID NO: 424 | 6902 |
| OC271 | PDGFRβ/VEGF-A | Heavy chain variable region | Cluster # 1476 | US20110177074 SEQ ID NO: 428 | 6903 |
| OC272 | PDGFRβ/VEGF-A | Heavy chain variable region | Cluster # 1479 | US20110177074 SEQ ID NO: 432 | 6904 |
| OC273 | PDGFRβ/VEGF-A | Heavy chain variable region | Cluster # 997 | US20110177074 SEQ ID NO: 44 | 6905 |
| OC274 | PDGFRβ/VEGF-A | Heavy chain variable region | Cluster # 1035 | US20110177074 SEQ ID NO: 48 | 6906 |
| OC275 | PDGFRβ/VEGF-A | Heavy chain variable region | Cluster # 1223 | US20110177074 SEQ ID NO: 52 | 6907 |
| OC276 | PDGFRβ/VEGF-A | Heavy chain variable region | Cluster # 1228 | US20110177074 SEQ ID NO: 56 | 6908 |
| OC277 | PDGFRβ/VEGF-A | Heavy chain variable region | Cluster # 1230 | US20110177074 SEQ ID NO: 60 | 6909 |
| OC278 | PDGFRβ/VEGF-A | Heavy chain variable region | Cluster # 1231 | US20110177074 SEQ ID NO: 64 | 6910 |
| OC279 | PDGFRβ/VEGF-A | Heavy chain variable region | Cluster # 1236 | US20110177074 SEQ ID NO: 68 | 6911 |
| OC280 | PDGFRβ/VEGF-A | Heavy chain variable region | Cluster # 1238 | US20110177074 SEQ ID NO: 72 | 6912 |

TABLE 11-continued

Ocular Disease Antibodies

| Antibody No. | Target | Description | Antibody Name | Reference Information | SEQ ID NO |
|---|---|---|---|---|---|
| OC281 | PDGFRβ/VEGF-A | Heavy chain variable region | Cluster # 1244 | US20110177074 SEQ ID NO: 76 | 6913 |
| OC282 | PDGFRβ/VEGF-A | Heavy chain variable region | Cluster # 1245 | US20110177074 SEQ ID NO: 80 | 6915 |
| OC283 | PDGFRβ/VEGF-A | Heavy chain variable region | Cluster # 1299 | US20110177074 SEQ ID NO: 84 | 6916 |
| OC284 | PDGFRβ/VEGF-A | Heavy chain variable region | Cluster # 1312 | US20110177074 SEQ ID NO: 88 | 6917 |
| OC285 | PDGFRβ/VEGF-A | Heavy chain variable region | Cluster # 1314 | US20110177074 SEQ ID NO: 92 | 6918 |
| OC286 | PDGFRβ/VEGF-A | Heavy chain variable region | Cluster # 1317 | US20110177074 SEQ ID NO: 96 | 6919 |
| OC287 | PDGFRβ/VEGF-A | Heavy chain variable region | Cluster # 597 | US20110177074 SEQ ID NO: 8 | 6914 |
| OC288 | RGMa | Heavy chain variable region | AE12-1 | US20140023659 SEQ ID NO: 1 | 3164 |
| OC289 | RGMa | Heavy chain variable region | AE12-20 | US20140023659 SEQ ID NO: 107 | 3165 |
| OC290 | RGMa | Heavy chain variable region | AE12-21 | US20140023659 SEQ ID NO: 115 | 3166 |
| OC291 | RGMa | Heavy chain variable region | AE12-23 | US20140023659 SEQ ID NO: 123 | 3167 |
| OC292 | RGMa | Heavy chain variable region | AE12-24 | US20140023659 SEQ ID NO: 131 | 3168 |
| OC293 | RGMa | Heavy chain variable region | AE12-3 | US20140023659 SEQ ID NO: 17 | 3169 |
| OC294 | RGMa | Heavy chain variable region | AE12-4 | US20140023659 SEQ ID NO: 25 | 3170 |
| OC295 | RGMa | Heavy chain variable region | AE12-5 | US20140023659 SEQ ID NO: 33 | 3171 |
| OC296 | RGMa | Heavy chain variable region | AE12-6 | US20140023659 SEQ ID NO: 41 | 3172 |
| OC297 | RGMa | Heavy chain variable region | AE12-7 | US20140023659 SEQ ID NO: 49 | 3173 |
| OC298 | RGMa | Heavy chain variable region | AE12-8 | US20140023659 SEQ ID NO: 57 | 3174 |
| OC299 | RGMa | Heavy chain variable region | AE12-2 | US20140023659 SEQ ID NO: 9 | 3175 |
| OC300 | RGMa | Heavy chain variable region | AE12-13 | US20140023659 SEQ ID NO: 91 | 3176 |
| OC301 | RGMa | Heavy chain variable region | AE12-15 | US20140023659 SEQ ID NO: 99 | 3177 |
| OC302 | S1P4 | Heavy chain variable region |  | WO2015057939 SEQ ID NO: 7 | 4323 |
| OC303 | VEGF, C5, Factor P, Factor D, EPO, EPOR, IL-1β, IL-17A, Il-10, TNFα, or FGFR2 | Heavy chain variable region | NVS73 | US20140186350 SEQ ID 111 | 17809 |
| OC304 | VEGF, C5, Factor P, Factor D, EPO, EPOR, IL-1β, IL-17A, Il-10, TNFα, or FGFR2 | Heavy chain variable region | NVS75 | US20140186350 SEQ ID 193 | 17810 |
| OC305 | VEGF, C5, Factor P, Factor D, EPO, EPOR, IL-1β, IL-17A, Il-10, TNFα, or FGFR2 | Heavy chain variable region | NVS70 | US20140186350 SEQ ID 40 | 17811 |
| OC306 | VEGF, C5, Factor P, Factor D, EPO, EPOR, IL-1β, IL-17A, Il-10, TNFα, or FGFR2 | Heavy chain variable region | NVS71 | US20140186350 SEQ ID 59 | 17812 |
| OC307 | VEGF, C5, Factor P, Factor D, EPO, EPOR, IL-1β, IL-17A, Il-10, TNFα, or FGFR2 | Heavy chain variable region | NVS4 | US20140186350 SEQ ID 7 | 17813 |

TABLE 11-continued

Ocular Disease Antibodies

| Antibody No. | Target | Description | Antibody Name | Reference Information | SEQ ID NO |
|---|---|---|---|---|---|
| OC308 | VEGF, C5, Factor P, Factor D, EPO, EPOR, IL-1β, IL-17A, Il-10, TNFα, or FGFR2 | Heavy chain variable region | NVS72 | US20140186350 SEQ ID 81 | 17814 |
| OC309 | VEGF-A | Heavy chain variable region | H6 | US20140086829 SEQ ID 4 | 7022 |
| OC310 | VEGF-A | Heavy chain variable region | H5 | US20140086829 SEQ ID 5 | 7023 |
| OC311 | VEGF-A | Heavy chain variable region | H7 | US20140086829 SEQ ID 6 | 7024 |
| OC312 | C5a | Heavy chain with signal peptide | BNJ364 | US20130224187 SEQ ID 24 | 7271 |
| OC313 | C5a | Heavy chain with signal peptide | BNJ367, BNJ371, BNJ378 | US20130224187 SEQ ID 32 | 7272 |
| OC314 | C5a | Heavy chain with signal peptide | BNJ366 | US20130224187 SEQ ID 43 | 7273 |
| OC315 | C5a | Heavy chain with signal peptide | BNJ369, BNJ381, BNJ383 | US20130224187 SEQ ID 48 | 7274 |
| OC316 | Annexin IV or a phospholipid; and (b) a complement inhibitor | Light chain | B4 | WO2014116880 SEQ ID 13 | 7389 |
| OC317 | Annexin IV or a phospholipid; and (b) a complement inhibitor | Light chain | B4 | WO2014116880 SEQ ID 14 | 7390 |
| OC318 | Annexin IV or a phospholipid; and (b) a complement inhibitor | Light chain | C2 | WO2014116880 SEQ ID 34 | 7391 |
| OC319 | Annexin IV or a phospholipid; and (b) a complement inhibitor | Light chain | C2 | WO2014116880 SEQ ID 35 | 7392 |
| OC320 | C3b | Light chain | rhuMAB 4D5-8 | U.S. Pat. No. 8,377,437 SEQ ID 13 | 7396 |
| OC321 | C3b, Properdin (factor P), Factors Ba and Bb, C5, C6, C7, C8, C9 | Light chain | L-1 | WO2015099838 SEQ ID 1 | 7397 |
| OC322 | C3b, Properdin (factor P), Factors Ba and Bb, C5, C6, C7, C8, C9 | Light chain | L-10 | WO2015099838 SEQ ID 10 | 7398 |
| OC323 | C3b, Properdin (factor P), Factors Ba and Bb, C5, C6, C7, C8, C9 | Light chain | L-11 | WO2015099838 SEQ ID 11 | 7399 |
| OC324 | C3b, Properdin (factor P), Factors Ba and Bb, C5, C6, C7, C8, C9 | Light chain | L-12 | WO2015099838 SEQ ID 12 | 7400 |
| OC325 | C3b, Properdin (factor P), Factors Ba and Bb, C5, C6, C7, C8, C9 | Light chain | L-13 | WO2015099838 SEQ ID 13 | 7401 |

TABLE 11-continued

Ocular Disease Antibodies

| Antibody No. | Target | Description | Antibody Name | Reference Information | SEQ ID NO |
|---|---|---|---|---|---|
| OC326 | C3b, Properdin (factor P), Factors Ba and Bb, C5, C6, C7, C8, C9 | Light chain | L-14 | WO2015099838 SEQ ID 14 | 7402 |
| OC327 | C3b, Properdin (factor P), Factors Ba and Bb, C5, C6, C7, C8, C9 | Light chain | L-15 | WO2015099838 SEQ ID 15 | 7403 |
| OC328 | C3b, Properdin (factor P), Factors Ba and Bb, C5, C6, C7, C8, C9 | Light chain | L-16 | WO2015099838 SEQ ID 16 | 7404 |
| OC329 | C3b, Properdin (factor P), Factors Ba and Bb, C5, C6, C7, C8, C9 | Light chain | L-17 | WO2015099838 SEQ ID 17 | 7405 |
| OC330 | C3b, Properdin (factor P), Factors Ba and Bb, C5, C6, C7, C8, C9 | Light chain | L-18 | WO2015099838 SEQ ID 18 | 7406 |
| OC331 | C3b, Properdin (factor P), Factors Ba and Bb, C5, C6, C7, C8, C9 | Light chain | L-19 | WO2015099838 SEQ ID 19 | 7407 |
| OC332 | C3b, Properdin (factor P), Factors Ba and Bb, C5, C6, C7, C8, C9 | Light chain | L-2 | WO2015099838 SEQ ID 2 | 7408 |
| OC333 | C3b, Properdin (factor P), Factors Ba and Bb, C5, C6, C7, C8. C9 | Light chain | L-20 | WO2015099838 SEQ ID 20 | 7409 |
| OC334 | C3b, Properdin (factor P), Factors Ba and Bb, C5, C6, C7, C8, C9 | Light chain | L-21 | WO2015099838 SEQ ID 21 | 7410 |
| OC335 | C3b, Properdin (factor P), Factors Ba and Bb, C5, C6, C7, C8, C9 | Light chain | L-22 | WO2015099838 SEQ ID 22 | 7411 |
| OC336 | C3b, Properdin (factor P), Factors Ba and Bb, C5, C6, C7, C8, C9 | Light chain | L-23 | WO2015099838 SEQ ID 23 | 7412 |
| OC337 | C3b, Properdin (factor P), Factors Ba and Bb, C5, C6, C7, C8, C9 | Light chain | L-24 | WO2015099838 SEQ ID 24 | 7413 |
| OC338 | C3b, Properdin (factor P), Factors Ba and Bb, C5, C6, C7, C8, C9 | Light chain | L-25 | WO2015099838 SEQ ID NO: 25 | 7414 |
| OC339 | C3b, Properdin (factor P), Factors Ba and Bb, C5, C6, C7, C8, C9 | Light chain | L-26 | WO2015099838 SEQ ID NO: 26 | 7415 |
| OC340 | C3b, Properdin (factor P), Factors Ba and Bb, C5, C6, C7, C8, C9 | Light chain | L-27 | WO2015099838 SEQ ID NO: 27 | 7416 |

TABLE 11-continued

Ocular Disease Antibodies

| Antibody No. | Target | Description | Antibody Name | Reference Information | SEQ ID NO |
|---|---|---|---|---|---|
| OC341 | C3b, Properdin (factor P), Factors Ba and Bb, C5, C6, C7, C8, C9 | Light chain | L-28 | WO2015099838 SEQ ID NO: 28 | 7417 |
| OC342 | C3b, Properdin (factor P), Factors Ba and Bb, C5, C6, C7, C8, C9 | Light chain | L-29 | WO2015099838 SEQ ID NO: 29 | 7418 |
| OC343 | C3b, Properdin (factor P), Factors Ba and Bb, C5, C6, C7, C8, C9 | Light chain | L-3 | WO2015099838 SEQ ID NO: 3 | 7419 |
| OC344 | C3b, Properdin (factor P), Factors Ba and Bb, C5, C6, C7, C8, C9 | Light chain | L-30 | WO2015099838 SEQ ID NO: 30 | 7420 |
| OC345 | C3b, Properdin (factor P), Factors Ba and Bb, C5, C6, C7, C8, C9 | Light chain | L-31 | WO2015099838 SEQ ID NO: 31 | 7421 |
| OC346 | C3b, Properdin (factor P), Factors Ba and Bb, C5, C6, C7, C8, C9 | Light chain | L-32 | WO2015099838 SEQ ID NO: 32 | 7422 |
| OC347 | C3b, Properdin (factor P), Factors Ba and Bb, C5, C6, C7, C8, C9 | Light chain | L-33 | WO2015099838 SEQ ID NO: 33 | 7423 |
| OC348 | C3b, Properdin (factor P), Factors Ba and Bb, C5, C6, C7, C8, C9 | Light chain | L-34 | WO2015099838 SEQ ID NO: 34 | 7424 |
| OC349 | C3b, Properdin (factor P), Factors Ba and Bb, C5, C6, C7, C8, C9 | Light chain | L-35 | WO2015099838 SEQ ID NO: 35 | 7425 |
| OC350 | C3b, Properdin (factor P), Factors Ba and Bb, C5, C6, C7, C8, C9 | Light chain | L-36 | WO2015099838 SEQ ID NO: 36 | 7426 |
| OC351 | C3b, Properdin (factor P), Factors Ba and Bb, C5, C6, C7, C8, C9 | Light chain | L-37 | WO2015099838 SEQ ID NO: 37 | 7427 |
| OC352 | C3b, Properdin (factor P), Factors Ba and Bb, C5, C6, C7, C8, C9 | Light chain | L-38 | WO2015099838 SEQ ID NO: 38 | 7428 |
| OC353 | C3b, Properdin (factor P), Factors Ba and Bb, C5, C6, C7, C8, C9 | Light chain | L-39 | WO2015099838 SEQ ID NO: 39 | 7429 |
| OC354 | C3b, Properdin (factor P), Factors Ba and Bb, C5, C6, C7, C8, C9 | Light chain | L-4 | WO2015099838 SEQ ID NO: 4 | 7430 |
| OC355 | C3b, Properdin (factor P), Factors Ba and Bb, C5, C6, C7, C8, C9 | Light chain | L-40 | WO2015099838 SEQ ID NO: 40 | 7431 |

TABLE 11-continued

Ocular Disease Antibodies

| Antibody No. | Target | Description | Antibody Name | Reference Information | SEQ ID NO |
|---|---|---|---|---|---|
| OC356 | C3b, Properdin (factor P), Factors Ba and Bb, C5, C6, C7, C8, C9 | Light chain | L-41 | WO2015099838 SEQ ID NO: 41 | 7432 |
| OC357 | C3b, Properdin (factor P), Factors Ba and Bb, C5, C6, C7, C8, C9 | Light chain | L-42 | WO2015099838 SEQ ID NO: 42 | 7433 |
| OC358 | C3b, Properdin (factor P), Factors Ba and Bb, C5, C6, C7, C8, C9 | Light chain | L-43 | WO2015099838 SEQ ID NO: 43 | 7434 |
| OC359 | C3b, Properdin (factor P), Factors Ba and Bb, C5, C6, C7, C8, C9 | Light chain | L-5 | WO2015099838 SEQ ID NO: 5 | 7435 |
| OC360 | C3b, Properdin (factor P), Factors Ba and Bb, C5, C6, C7, C8, C9 | Light chain | L-6 | WO2015099838 SEQ ID NO: 6 | 7436 |
| OC361 | C3b, Properdin (factor P), Factors Ba and Bb, C5, C6, C7, C8, C9 | Light chain | L-7 | WO2015099838 SEQ ID NO: 7 | 7437 |
| OC362 | C3b, Properdin (factor P), Factors Ba and Bb, C5, C6, C7, C8, C9 | Light chain | L-8 | WO2015099838 SEQ ID NO: 8 | 7438 |
| OC363 | C3b, Properdin (factor P), Factors Ba and Bb, C5, C6, C7, C8, C9 | Light chain | L-9 | WO2015099838 SEQ ID NO: 9 | 7439 |
| OC364 | C5 | Light chain | NVS962 | US20150158936 SEQ ID 10 | 7446 |
| OC365 | C5 | Light chain | NVS808 | US20150158936 SEQ ID 108 | 7447 |
| OC366 | C5 | Light chain | NVS806 | US20150158936 SEQ ID 122 | 7448 |
| OC367 | C5 | Light chain | NVS804 | US20150158936 SEQ ID 136 | 7449 |
| OC368 | C5 | Light chain | NVS809 | US20150158936 SEQ ID 150 | 7450 |
| OC369 | C5 | Light chain | NVS805 | US20150158936 SEQ ID 164 | 7451 |
| OC370 | C5 | Light chain | NVS962-S | US20150158936 SEQ ID 178 | 7452 |
| OC371 | C5 | Light chain | NVS962-Q | US20150158936 SEQ ID 192 | 7453 |
| OC372 | C5 | Light chain | NVS962-S31A | US20150158936 SEQ ID 206 | 7454 |
| OC373 | C5 | Light chain | NVS962-G | US20150158936 SEQ ID 220 | 7455 |
| OC374 | C5 | Light chain | NVS962-T | US20150158936 SEQ ID 234 | 7456 |
| OC375 | C5 | Light chain | NVS963 | US20150158936 SEQ ID 24 | 7457 |
| OC376 | C5 | Light chain | NVS965-T | US20150158936 SEQ ID 248 | 7458 |
| OC377 | C5 | Light chain | NVS965-Q | US20150158936 SEQ ID 262 | 7459 |
| OC378 | C5 | Light chain | NVS965-S | US20150158936 SEQ ID 276 | 7460 |
| OC379 | C5 | Light chain | NVS964 | US20150158936 SEQ ID 38 | 7461 |
| OC380 | C5 | Light chain | Antibody 8109 | US20150158936 SEQ ID 419 | 7462 |

TABLE 11-continued

Ocular Disease Antibodies

| Antibody No. | Target | Description | Antibody Name | Reference Information | SEQ ID NO |
|---|---|---|---|---|---|
| OC381 | C5 | Light chain | Antibody 8110 | US20150158936 SEQ ID 435 | 7463 |
| OC382 | C5 | Light chain | Antibody 8111 | US20150158936 SEQ ID 450 | 7464 |
| OC383 | C5 | Light chain | Antibody 8113 | US20150158936 SEQ ID 463 | 7465 |
| OC384 | C5 | Light chain | Antibody 8114 | US20150158936 SEQ ID 479 | 7466 |
| OC385 | C5 | Light chain | NVS966 | US20150158936 SEQ ID 52 | 7467 |
| OC386 | C5 | Light chain | NVS965 | US20150158936 SEQ ID 66 | 7468 |
| OC387 | C5 | Light chain | NVS967 | US20150158936 SEQ ID 80 | 7469 |
| OC388 | C5 | Light chain | NVS807 | US20150158936 SEQ ID 94 | 7470 |
| OC389 | C5 | Light chain | L1 | US20150239966 SEQ ID 1 | 7471 |
| OC390 | C5 | Light chain | L6 | US20150239966 SEQ ID NO: 11 | 7472 |
| OC391 | C5 | Light chain | L2 | US20150239966 SEQ ID 3 | 7473 |
| OC392 | C5 | Light chain | L3 | US20150239966 SEQ ID NO: 5 | 7474 |
| OC393 | C5 | Light chain | L4 | US20150239966 SEQ ID NO: 7 | 7475 |
| OC394 | C5 | Light chain | L5 | US20150239966 SEQ ID NO: 9 | 7476 |
| OC395 | C5 | Light chain | Tesidolumab, "LEG 316, LFG-316, LFG316" | U.S. Pat. No. 8,241,628 SEQ ID 10 | 7477 |
| OC396 | C5 | Light chain |  | U.S. Pat. No. 9,133,269 SEQ ID 10 | 7478 |
| OC397 | C5 | Light chain |  | U.S. Pat. No. 9,133,269 SEQ ID 11 | 7479 |
| OC398 | C5 | Light chain |  | U.S. Pat. No. 9,133,269 SEQ ID 12 | 7480 |
| OC399 | C5 | Light chain |  | U.S. Pat. No. 9,133,269 SEQ ID 13 | 7481 |
| OC400 | C5 | Light chain |  | U.S. Pat. No. 9,133,269 SEQ ID 14 | 7482 |
| OC401 | C5 | Light chain |  | U.S. Pat. No. 9,133,269 SEQ ID 15 | 7483 |
| OC402 | C5 | Light chain |  | U.S. Pat. No. 9,133,269 SEQ ID 16 | 7484 |
| OC403 | C5 | Light chain |  | U.S. Pat. No. 9,133,269 SEQ ID 17 | 7485 |
| OC404 | C5 | Light chain |  | U.S. Pat. No. 9,133,269 SEQ ID 18 | 7486 |
| OC405 | C5 | Light chain |  | U.S. Pat. No. 9,133,269 SEQ ID 19 | 7487 |
| OC406 | C5 | Light chain |  | U.S. Pat. No. 9,133,269 SEQ ID 20 | 7488 |
| OC407 | C5 | Light chain |  | U.S. Pat. No. 9,133,269 SEQ ID 21 | 7489 |
| OC408 | C5 | Light chain |  | U.S. Pat. No. 9,133,269 SEQ ID 22 | 7490 |
| OC409 | C5 | Light chain |  | U.S. Pat. No. 9,133,269 SEQ ID 23 | 7491 |
| OC410 | C5 | Light chain |  | U.S. Pat. No. 9,133,269 SEQ ID 24 | 7492 |
| OC411 | C5 | Light chain |  | U.S. Pat. No. 9,133,269 SEQ ID 6 | 7493 |
| OC412 | C5 | Light chain |  | U.S. Pat. No. 9,133,269 SEQ ID 7 | 7494 |
| OC413 | C5 | Light chain |  | U.S. Pat. No. 9,133,269 SEQ ID 8 | 7495 |
| OC414 | C5 | Light chain |  | U.S. Pat. No. 9,133,269 SEQ ID 9 | 7496 |
| OC415 | C5a | Light chain | BNJ364, BNJ367, BNJ366, BNJ369 | US20130224187 SEQ ID 17 | 7503 |

TABLE 11-continued

Ocular Disease Antibodies

| Antibody No. | Target | Description | Antibody Name | Reference Information | SEQ ID NO |
|---|---|---|---|---|---|
| OC416 | C5a | Light chain | BNJ371, BNJ381 | US20130224187 SEQ ID 36 | 7504 |
| OC417 | C5a | Light chain | BNJ378, BNJ383 | US20130224187 SEQ ID 40 | 7505 |
| OC418 | CGRP | Light chain | Ab11 | US20120294802 SEQ ID NO: 102 | 17725 |
| OC419 | CGRP | Light chain | Ab12 | US20120294802 SEQ ID NO: 112 | 17726 |
| OC420 | CGRP | Light chain | Ab2 | US20120294802 SEQ ID NO: 12 | 17729 |
| OC421 | CGRP | Light chain | Ab13 | US20120294802 SEQ ID NO: 122 | 17727 |
| OC422 | CGRP | Light chain | Ab14 | US20120294802 SEQ ID NO: 132 | 17728 |
| OC423 | CGRP | Light chain | Ab1 | US20120294802 SEQ ID NO: 2 | 17723 |
| OC424 | CGRP | Light chain | Ab3 | US20120294802 SEQ ID NO: 22 | 17730 |
| OC425 | CGRP | Light chain | Ab4 | US20120294802 SEQ ID NO: 32 | 17731 |
| OC426 | CGRP | Light chain | Ab5 | US20120294802 SEQ ID NO: 42 | 17732 |
| OC427 | CGRP | Light chain | Ab6 | US20120294802 SEQ ID NO: 52 | 17733 |
| OC428 | CGRP | Light chain | Ab7 | US20120294802 SEQ ID NO: 62 | 17734 |
| OC429 | CGRP | Light chain | Ab8 | US20120294802 SEQ ID NO: 72 | 17735 |
| OC430 | CGRP | Light chain | Ab9 | US20120294802 SEQ ID NO: 82 | 17736 |
| OC431 | CGRP | Light chain | Ab10 | US20120294802 SEQ ID NO: 92 | 17724 |
| OC432 | Factor D | Light chain | Fab 238 | WO2009134711 SEQ ID NO: 47 | 17815 |
| OC433 | Factor D, humanized IgG2 | Light Chain | Lampalizumab, | U.S. Pat. No. 8,273,352 SEQ ID NO: 47 | 17816 |
| OC434 | platelet-derived growth factor receptor beta PDGFRB | Light chain | Rinucumab, REGN2176 | | 17817 |
| OC435 | S1P4 | Light chain | | WO2015057939 SEQ ID NO: 41 | 4420 |
| OC436 | VEGF, C5, Factor P, Factor D, EPO, EPOR, IL-1β, IL-17A, Il-10, INFα, or FGFR2 | Light chain | NVS73, | US20140186350 SEQ ID 122 | 17818 |
| OC437 | VEGF, C5, Factor P, Factor D, EPO, EPOR, IL-1β, IL-17A, Il-10, INFα, or FGFR2 | Light chain | NVS81 | US20140186350 SEQ ID 158 | 17819 |
| OC438 | VEGF, C5, Factor P, Factor D, EPO, EPOR, IL-1β, IL-17A, Il-10, TNFα, or FGFR2 | Light chain | NVS81T | US20140186350 SEQ ID 160 | 17820 |
| OC439 | VEGF, C5, Factor P, Factor D, EPO, EPOR, IL-1β, IL-17A, Il-10, TNFα, or FGFR2 | Light chain | NVS82 | US20140186350 SEQ ID 162 | 17821 |
| OC440 | VEGF, C5, Factor P, Factor D, EPO, EPOR, IL-1β, IL-17A, Il-10, TNFα, or FGFR2 | Light chain | NVS82T | US20140186350 SEQ ID 164 | 17822 |
| OC441 | VEGF, C5, Factor P, Factor | Light chain | NVS1b | US20140186350 SEQ ID 172 | 17823 |

TABLE 11-continued

Ocular Disease Antibodies

| Antibody No. | Target | Description | Antibody Name | Reference Information | SEQ ID NO |
|---|---|---|---|---|---|
| | D, EPO, EPOR, IL-1β, IL-17A, Il-10, TNFα, or FGFR2 | | | | |
| OC442 | VEGF, C5, Factor P, Factor D, EPO, EPOR, IL-1β, IL-17A, Il-10, TNFα, or FGFR2 | Light chain | NVS1c | US20140186350 SEQ ID 174 | 17824 |
| OC443 | VEGF, C5, Factor P, Factor D, EPO, EPOR, IL-1β, IL-17A, Il-10, TNFα, or FGFR2 | Light chain | NVS1d | US20140186350 SEQ ID 176 | 17825 |
| OC444 | VEGF, C5, Factor P, Factor D, EPO, EPOR, IL-1β, IL-17A, Il-10, TNFα, or FGFR2 | Light chain | NVS1e | US20140186350 SEQ ID 178 | 17826 |
| OC445 | VEGF, C5, Factor P, Factor D, EPO, EPOR, IL-1β, IL-17A, Il-10, TNFα, or FGFR2 | Light chain | NVS1f | US20140186350 SEQ ID 180 | 17827 |
| OC446 | VEGF, C5, Factor P, Factor D, EPO, EPOR, IL-1β, IL-17A, Il-10, TNFα, or FGFR2 | Light chain | NVS1g | US20140186350 SEQ ID 182 | 17828 |
| OC447 | VEGF, C5, Factor P, Factor D, EPO, EPOR, IL-1β, IL-17A, Il-10, TNFα, or FGFR2 | Light chain | NVS1h | US20140186350 SEQ ID 184 | 17829 |
| OC448 | VEGF, C5, Factor P, Factor D, EPO, EPOR, IL-1β, IL-17A, Il-10, TNFα, or FGFR2 | Light chain | NVS1j | US20140186350 SEQ ID 185 | 17830 |
| OC449 | VEGF, C5, Factor P, Factor D, EPO, EPOR, IL-1β, IL-17A, Il-10, TNFα, or FGFR2 | Light chain | NVS4, NVS1, NVS2, NVS3, NVS36, NVS37 | US20140186350 SEQ ID 19 | 17831 |
| OC450 | VEGF, C5, Factor P, Factor D, EPO, EPOR, IL-1β, IL-17A, Il-10, TNFα, or FGFR2 | Light chain | NVS75, NVS74T, NCS75T | US20140186350 SEQ ID 202 | 17832 |
| OC451 | VEGF, C5, Factor P, Factor D, EPO, EPOR, IL-1β, IL-17A, Il-10, TNFα, or FGFR2 | Light chain | NVS70, NVS70T | US20140186350 SEQ ID 51 | 17833 |
| OC452 | VEGF, C5, Factor P, Factor D, EPO, EPOR, IL-1β, IL-17A, Il-10, TNFα, or FGFR2 | Light chain | NVS71, NVS71T | US20140186350 SEQ ID 73 | 17834 |
| OC453 | VEGF, C5, Factor P, Factor D, EPO, EPOR, IL-1β, IL-17A, | Light chain | NVS72, NVS72T | US20140186350 SEQ ID 95 | 17835 |

TABLE 11-continued

Ocular Disease Antibodies

| Antibody No. | Target | Description | Antibody Name | Reference Information | SEQ ID NO |
|---|---|---|---|---|---|
| | Il-10, TNFα, or FGFR2 | | | | |
| OC454 | sphingosine-1-phosphate | Light chain full | Sonepcizumab, S1P-LT1012 | | 17836 |
| OC455 | sphingosine-1-phosphate | Light chain variable | Sonepcizumab, S1P-LT1010 | | 17837 |
| OC456 | Factor D | Light chain variable region | Humanized Clone #111 | WO2009134711 SEQ ID NO: 1 | 17838 |
| OC457 | Factor D | Light chain variable region | Fab 238-4 | WO2009134711 SEQ ID NO: 10 | 17839 |
| OC458 | Factor D | Light chain variable region | Fab 238-5 | WO2009134711 SEQ ID NO: 11 | 17840 |
| OC459 | Factor D | Light chain variable region | Fab 238-6 | WO2009134711 SEQ ID NO: 12 | 17841 |
| OC460 | Factor D | Light chain variable region | Fab 238-7 | WO2009134711 SEQ ID NO: 13 | 17842 |
| OC461 | Factor D | Light chain variable region | Fab 238-8 | WO2009134711 SEQ ID NO: 14 | 17843 |
| OC462 | Factor D | Light chain variable region | Fab 238-9 | WO2009134711 SEQ ID NO: 15 | 17844 |
| OC463 | Factor D | Light chain variable region | Fab 238-10 | WO2009134711 SEQ ID NO: 16 | 17845 |
| OC464 | Factor D | Light chain variable region | Fab 238-11 | WO2009134711 SEQ ID NO: 17 | 17846 |
| OC465 | Factor D | Light chain variable region | L243 | WO2009134711 SEQ ID NO: 32 | 17847 |
| OC466 | Factor D | Light chain variable region | humanized L243 | WO2009134711 SEQ ID NO: 36 | 17848 |
| OC467 | Factor D | Light chain variable region | Fab 238 | WO2009134711 SEQ ID NO: 6 | 17849 |
| OC468 | Factor D | Light chain variable region | Fab 238-1 | WO2009134711 SEQ ID NO: 7 | 17850 |
| OC469 | Factor D | Light chain variable region | Fab 238-2 | WO2009134711 SEQ ID NO: 8 | 17851 |
| OC470 | Factor D | Light chain variable region | Fab 238-3 | WO2009134711 SEQ ID NO: 9 | 17852 |
| OC471 | LPG (lysophosphatidylglucoside) | Light chain variable region | #7 | U.S. Pat. No. 8,591,902 SEQ ID NO: 17 | 3329 |
| OC472 | LPG (lysophosphatidylglucoside) | Light chain variable region | #15 | U.S. Pat. No. 8,591,902 SEQ ID NO: 7 | 3330 |
| OC473 | PDGFR-beta | Light chain variable region | 3299N | US20140193402 SEQ ID 10 | 9142 |
| OC474 | PDGFR-beta | Light chain variable region | 3368N | US20140193402 SEQ ID 106 | 9143 |
| OC475 | PDGFR-beta | Light chain variable region | 3373N | US20140193402 SEQ ID 122 | 9144 |
| OC476 | PDGFR-beta | Light chain variable region | 3374N | US20140193402 SEQ ID 138 | 9145 |
| OC477 | PDGFR-beta | Light chain variable region | 3094P | US20140191402 SEQ ID 154 | 9146 |
| OC478 | PDGFR-beta | Light chain variable region | 3095S | US20140193402 SEQ ID 170 | 9147 |
| OC479 | PDGFR-beta | Light chain variable region | 3096S | US20140193402 SEQ ID 186 | 9148 |
| OC480 | PDGFR-beta | Light chain variable region | 3097S | US20140193402 SEQ ID 202 | 9149 |
| OC481 | PDGFR-beta | Light chain variable region | 3098S | US20140193402 SEQ ID 218 | 9150 |
| OC482 | PDGFR-beta | Light chain variable region | 3099S | US20140193402 SEQ ID 234 | 9151 |
| OC483 | PDGFR-beta | Light chain variable region | 3102S | US20140193402 SEQ ID 250 | 9152 |
| OC484 | PDGFR-beta | Light chain variable region | 3305N | US20140193402 SEQ ID 26 | 9153 |
| OC485 | PDGFR-beta | Light chain variable region | 3103S | US20140193402 SEQ ID 266 | 9154 |
| OC486 | PDGFR-beta | Light chain variable region | 3104S | US20140193402 SEQ ID 282 | 9155 |
| OC487 | PDGFR-beta | Light chain variable region | 3105S | US20140193402 SEQ ID 298 | 9156 |
| OC488 | PDGFR-beta | Light chain variable region | 3106S | US20140193402 SEQ ID 314 | 9157 |

TABLE 11-continued

Ocular Disease Antibodies

| Antibody No. | Target | Description | Antibody Name | Reference Information | SEQ ID NO |
|---|---|---|---|---|---|
| OC489 | PDGFR-beta | Light chain variable region | 3107S | US20140193402 SEQ ID 330 | 9158 |
| OC490 | PDGFR-beta | Light chain variable region | 3310N | US20140193402 SEQ ID 42 | 9159 |
| OC491 | PDGFR-beta | Light chain variable region | 3361N | US20140193402 SEQ ID 58 | 9160 |
| OC492 | PDGFR-beta | Light chain variable region | 3363N | US20140193402 SEQ ID 74 | 9161 |
| OC493 | PDGFR-beta | Light chain variable region | 3365N | US20140193402 SEQ ID 90 | 9162 |
| OC494 | PDGFRβ/VEGF-A | Light chain variable region | Cluster # 600 | US20110177074 SEQ ID NO: 10 | 9163 |
| OC495 | PDGFRβ/VEGF-A | Light chain variable region | Cluster # 1323 | US20110177074 SEQ ID NO: 102 | 9164 |
| OC496 | PDGFRβ/VEGF-A | Light chain variable region | Cluster # 1330 | US20110177074 SEQ ID NO: 106 | 9165 |
| OC497 | PDGFRβ/VEGF-A | Light chain variable region | Cluster # 1334 | US20110177074 SEQ ID NO: 110 | 9166 |
| OC498 | PDGFRβ/VEGF-A | Light chain variable region | Cluster # 1345 | US20110177074 SEQ ID NO: 114 | 9167 |
| OC499 | PDGFRβ/VEGF-A | Light chain variable region | Cluster # 1346 | US20110177074 SEQ ID NO: 118 | 9168 |
| OC500 | PDGFRβ/VEGF-A | Light chain variable region | Cluster # 1359 | US20110177074 SEQ ID NO: 122 | 9169 |
| OC501 | PDGFRβ/VEGF-A | Light chain variable region | Cluster # 1365 | US20110177074 SEQ ID NO: 126 | 9170 |
| OC502 | PDGFRβ/VEGF-A | Light chain variable region | Cluster # 1402 | US20110177074 SEQ ID NO: 130 | 9171 |
| OC503 | PDGFRβ/VEGF-A | Light chain variable region | Cluster # 1515 | US20110177074 SEQ ID NO: 134 | 9172 |
| OC504 | PDGFRβ/VEGF-A | Light chain variable region | Cluster # 1531 | US20110177074 SEQ ID NO: 138 | 9173 |
| OC505 | PDGFRβ/VEGF-A | Light chain variable region | Cluster # 607 | US20110177074 SEQ ID NO: 14 | 9174 |
| OC506 | PDGFRβ/VEGF-A | Light chain variable region | Cluster # 1535 | US20110177074 SEQ ID NO: 142 | 9175 |
| OC507 | PDGFRβ/VEGF-A | Light chain variable region | Cluster # 1541 | US20110177074 SEQ ID NO: 146 | 9176 |
| OC508 | PDGFRβ/VEGF-A | Light chain variable region | Cluster # 1550 | US20110177074 SEQ ID NO: 150 | 9177 |
| OC509 | PDGFRβ/VEGF-A | Light chain variable region | Cluster # 1564 | US20110177074 SEQ ID NO: 154 | 9178 |
| OC510 | PDGFRβ/VEGF-A | Light chain variable region | Cluster # 1601 | US20110177074 SEQ ID NO: 158 | 9179 |
| OC511 | PDGFRβ/VEGF-A | Light chain variable region | Cluster # 1629 | US20110177074 SEQ ID NO: 162 | 9180 |
| OC512 | PDGFRβ/VEGF-A | Light chain variable region | Cluster # 635 | US20110177074 SEQ ID NO: 166 | 9181 |
| OC513 | PDGFRβ/VEGF-A | Light chain variable region | Cluster # 636 | US20110177074 SEQ ID NO: 170 | 9182 |
| OC514 | PDGFRβ/VEGF-A | Light chain variable region | Cluster # 638 | US20110177074 SEQ ID NO: 174 | 9183 |
| OC515 | PDGFRβ/VEGF-A | Light chain variable region | Cluster # 656 | US20110177074 SEQ ID NO: 178 | 9184 |
| OC516 | PDGFRβ/VEGF-A | Light chain variable region | Cluster # 613 | US20110177074 SEQ ID NO: 18 | 9185 |
| OC517 | PDGFRβ/VEGF-A | Light chain variable region | Cluster # 665 | US20110177074 SEQ ID NO: 182 | 9186 |
| OC518 | PDGFRβ/VEGF-A | Light chain variable region | Cluster # 668 | US20110177074 SEQ ID NO: 186 | 9187 |
| OC519 | PDGFRβ/VEGF-A | Light chain variable region | Cluster # 669 | US20110177074 SEQ ID NO: 190 | 9188 |
| OC520 | PDGFRβ/VEGF-A | Light chain variable region | Cluster # 679 | US20110177074 SEQ ID NO: 194 | 9189 |
| OC521 | PDGFRβ/VEGF-A | Light chain variable region | Cluster # 695 | US20110177074 SEQ ID NO: 198 | 9190 |
| OC522 | PDGFRβ/VEGF-A | Light chain variable region | Cluster # 709 | US20110177074 SEQ ID NO: 202 | 9191 |
| OC523 | PDGFRβ/VEGF-A | Light chain variable region | Cluster # 710 | US20110177074 SEQ ID NO: 206 | 9192 |
| OC524 | PDGFRβ/VEGF-A | Light chain variable region | Cluster # 741 | US20110177074 SEQ ID NO: 210 | 9193 |
| OC525 | PDGFRβ/VEGF-A | Light chain variable region | Cluster # 752 | US20110177074 SEQ ID NO: 214 | 9194 |

TABLE 11-continued

Ocular Disease Antibodies

| Antibody No. | Target | Description | Antibody Name | Reference Information | SEQ ID NO |
|---|---|---|---|---|---|
| OC526 | PDGFRβ/VEGF-A | Light chain variable region | Cluster # 772 | US20110177074 SEQ ID NO: 218 | 9195 |
| OC527 | PDGFRβ/VEGF-A | Light chain variable region | Cluster # 941 | US20110177074 SEQ ID NO: 22 | 9196 |
| OC528 | PDGFRβ/VEGF-A | Light chain variable region | Cluster # 779 | US20110177074 SEQ ID NO: 222 | 9197 |
| OC529 | PDGFRβ/VEGF-A | Light chain variable region | Cluster # 799 | US20110177074 SEQ ID NO: 226 | 9198 |
| OC530 | PDGFRβ/VEGF-A | Light chain variable region | Cluster # 830 | US20110177074 SEQ ID NO: 230 | 9199 |
| OC531 | PDGFRβ/VEGF-A | Light chain variable region | Cluster # 844 | US20110177074 SEQ ID NO: 234 | 9200 |
| OC532 | PDGFRβ/VEGF-A | Light chain variable region | Cluster # 847 | US20110177074 SEQ ID NO: 238 | 9201 |
| OC533 | PDGFRβ/VEGF-A | Light chain variable region | Cluster # 868 | US20110177074 SEQ ID NO: 242 | 9202 |
| OC534 | PDGFRβ/VEGF-A | Light chain variable region | Cluster # 870 | US20110177074 SEQ ID NO: 246 | 9203 |
| OC535 | PDGFRβ/VEGF-A | Light chain variable region | Cluster # 883 | US20110177074 SEQ ID NO: 250 | 9204 |
| OC536 | PDGFRβ/VEGF-A | Light chain variable region | Cluster # 887 | US20110177074 SEQ ID NO: 254 | 9205 |
| OC537 | PDGFRβ/VEGF-A | Light chain variable region | Cluster # 901 | US20110177074 SEQ ID NO: 258 | 9206 |
| OC538 | PDGFRβ/VEGF-A | Light chain variable region | Cluster # 946 | US20110177074 SEQ ID NO: 26 | 9207 |
| OC539 | PDGFRβ/VEGF-A | Light chain variable region | Cluster # 905 | US20110177074 SEQ ID NO: 262 | 9208 |
| OC540 | PDGFRβ/VEGF-A | Light chain variable region | Cluster # 909 | US20110177074 SEQ ID NO: 266 | 9209 |
| OC541 | PDGFRβ/VEGF-A | Light chain variable region | Cluster # 928 | US20110177074 SEQ ID NO: 270 | 9210 |
| OC542 | PDGFRβ/VEGF-A | Light chain variable region | Cluster # 1036 | US20110177074 SEQ ID NO: 274 | 9211 |
| OC543 | PDGFRβ/VEGF-A | Light chain variable region | Cluster # 1039 | US20110177074 SEQ ID NO: 278 | 9212 |
| OC544 | PDGFRβ/VEGF-A | Light chain variable region | Cluster # 1040 | US20110177074 SEQ ID NO: 282 | 9213 |
| OC545 | PDGFRβ/VEGF-A | Light chain variable region | Cluster # 1044 | US20110177074 SEQ ID NO: 286 | 9214 |
| OC546 | PDGFRβ/VEGF-A | Light chain variable region | Cluster # 1048 | US20110177074 SEQ ID NO: 290 | 9215 |
| OC547 | PDGFRβ/VEGF-A | Light chain variable region | Cluster # 1056 | US20110177074 SEQ ID NO: 294 | 9216 |
| OC548 | PDGFRβ/VEGF-A | Light chain variable region | Cluster # 1064 | US20110177074 SEQ ID NO: 298 | 9217 |
| OC549 | PDGFRβ/VEGF-A | Light chain variable region | Cluster # 947 | US20110177074 SEQ ID NO: 30 | 9218 |
| OC550 | PDGFRβ/VEGF-A | Light chain variable region | Cluster # 1080 | US20110177074 SEQ ID NO: 302 | 9219 |
| OC551 | PDGFRβ/VEGF-A | Light chain variable region | Cluster # 1092 | US20110177074 SEQ ID NO: 306 | 9220 |
| OC552 | PDGFRβ/VEGF-A | Light chain variable region | Cluster # 1094 | US20110177074 SEQ ID NO: 310 | 9221 |
| OC553 | PDGFRβ/VEGF-A | Light chain variable region | Cluster # 1096 | US20110177074 SEQ ID NO: 314 | 9222 |
| OC554 | PDGFRβ/VEGF-A | Light chain variable region | Cluster # 1107 | US20110177074 SEQ ID NO: 318 | 9223 |
| OC555 | PDGFRβ/VEGF-A | Light chain variable region | Cluster # 1111 | US20110177074 SEQ ID NO: 322 | 9224 |
| OC556 | PDGFRβ/VEGF-A | Light chain variable region | Cluster # 1123 | US20110177074 SEQ ID NO: 326 | 9225 |
| OC557 | PDGFRβ/VEGF-A | Light chain variable region | Cluster # 1135 | US20110177074 SEQ ID NO: 330 | 9226 |
| OC558 | PDGFRβ/VEGF-A | Light chain variable region | Cluster # 1142 | US20110177074 SEQ ID NO: 334 | 9227 |
| OC559 | PDGFRβ/VEGF-A | Light chain variable region | Cluster # 1155 | US20110177074 SEQ ID NO: 338 | 9228 |
| OC560 | PDGFRβ/VEGF-A | Light chain variable region | Cluster # 949 | US20110177074 SEQ ID NO: 34 | 9229 |
| OC561 | PDGFRβ/VEGF-A | Light chain variable region | Cluster # 1250 | US20110177074 SEQ ID NO: 342 | 9230 |
| OC562 | PDGFRβ/VEGF-A | Light chain variable region | Cluster # 1252 | US20110177074 SEQ ID NO: 346 | 9231 |

TABLE 11-continued

Ocular Disease Antibodies

| Antibody No. | Target | Description | Antibody Name | Reference Information | SEQ ID NO |
|---|---|---|---|---|---|
| OC563 | PDGFRβ/VEGF-A | Light chain variable region | Cluster # 1254 | US20110177074 SEQ ID NO: 350 | 9232 |
| OC564 | PDGFRβ/VEGF-A | Light chain variable region | Cluster # 1257 | US20110177074 SEQ ID NO: 354 | 9233 |
| OC565 | PDGFRβ/VEGF-A | Light chain variable region | Cluster # 1264 | US20110177074 SEQ ID NO: 358 | 9234 |
| OC566 | PDGFRβ/VEGF-A | Light chain variable region | Cluster # 1266 | US20110177074 SEQ ID NO: 362 | 9235 |
| OC567 | PDGFRβ/VEGF-A | Light chain variable region | Cluster # 1268 | US20110177074 SEQ ID NO: 366 | 9236 |
| OC568 | PDGFRβ/VEGF-A | Light chain variable region | Cluster # 1269 | US20110177074 SEQ ID NO: 370 | 9237 |
| OC569 | PDGFRβ/VEGF-A | Light chain variable region | Cluster #1270 | US20110177074 SEQ ID NO: 374 | 9238 |
| OC570 | PDGFRβ/VEGF-A | Light chain variable region | Cluster # 1281 | US20110177074 SEQ ID NO: 378 | 9239 |
| OC571 | PDGFRβ/VEGF-A | Light chain variable region | Cluster # 975 | US20110177074 SEQ ID NO: 38 | 9240 |
| OC572 | PDGFRβ/VEGF-A | Light chain variable region | Cluster # 1283 | US20110177074 SEQ ID NO: 382 | 9241 |
| OC573 | PDGFRβ/VEGF-A | Light chain variable region | Cluster # 1285 | US20110177074 SEQ ID NO: 386 | 9242 |
| OC574 | PDGFRβ/VEGF-A | Light chain variable region | Cluster # 1409 | US20110177074 SEQ ID NO: 390 | 9243 |
| OC575 | PDGFRβ/VEGF-A | Light chain variable region | Cluster # 1410 | US20110177074 SEQ ID NO: 394 | 9244 |
| OC576 | PDGFRβ/VEGF-A | Light chain variable region | Cluster # 1413 | US20110177074 SEQ ID NO: 398 | 9245 |
| OC577 | PDGFRβ/VEGF-A | Light chain variable region | Cluster # 1416 | US20110177074 SEQ ID NO: 402 | 9246 |
| OC578 | PDGFRβ/VEGF-A | Light chain variable region | Cluster # 1420 | US20110177074 SEQ ID NO: 406 | 9247 |
| OC579 | PDGFRβ/VEGF-A | Light chain variable region | Cluster # 1428 | US20110177074 SEQ ID NO: 410 | 9248 |
| OC580 | PDGFRβ/VEGF-A | Light chain variable region | Cluster # 1437 | US20110177074 SEQ ID NO: 414 | 9249 |
| OC581 | PDGFRβ/VEGF-A | Light chain variable region | Cluster # 1449 | US20110177074 SEQ ID NO: 418 | 9250 |
| OC582 | PDGFRβ/VEGF-A | Light chain variable region | Cluster # 997 | US20110177074 SEQ ID NO: 42 | 9251 |
| OC583 | PDGFRβ/VEGF-A | Light chain variable region | Cluster # 1458 | US20110177074 SEQ ID NO: 422 | 9252 |
| OC584 | PDGFRβ/VEGF-A | Light chain variable region | Cluster # 1476 | US20110177074 SEQ ID NO: 426 | 9253 |
| OC585 | PDGFRβ/VEGF-A | Light chain variable region | Cluster # 1479 | US20110177074 SEQ ID NO: 430 | 9254 |
| OC586 | PDGFRβ/VEGF-A | Light chain variable region | Cluster # 1035 | US20110177074 SEQ ID NO: 46 | 9255 |
| OC587 | PDGFRβ/VEGF-A | Light chain variable region | Cluster # 1228 | US20110177074 SEQ ID NO: 54 | 9257 |
| OC588 | PDGFRβ/VEGF-A | Light chain variable region | Cluster # 1230 | US20110177074 SEQ ID NO: 58 | 9258 |
| OC589 | PDGFRβ/VEGF-A | Light chain variable region | Cluster # 1231 | US20110177074 SEQ ID NO: 62 | 9260 |
| OC590 | PDGFRβ/VEGF-A | Light chain variable region | Cluster # 1236 | US20110177074 SEQ ID NO: 66 | 9261 |
| OC591 | PDGFRβ/VEGF-A | Light chain variable region | Cluster # 1238 | US20110177074 SEQ ID NO: 70 | 9262 |
| OC592 | PDGFRβ/VEGF-A | Light chain variable region | Cluster # 1244 | US20110177074 SEQ ID NO: 74 | 9263 |
| OC593 | PDGFRβ/VEGF-A | Light chain variable region | Cluster # 1245 | US20110177074 SEQ ID NO: 78 | 9264 |
| OC594 | PDGFRβ/VEGF-A | Light chain variable region | Cluster # 1299 | US20110177074 SEQ ID NO: 82 | 9265 |
| OC595 | PDGFRβ/VEGF-A | Light chain variable region | Cluster # 1312 | US20110177074 SEQ ID NO: 86 | 9266 |
| OC596 | PDGFRβ/VEGF-A | Light chain variable region | Cluster # 1314 | US20110177074 SEQ ID NO: 90 | 9267 |
| OC597 | PDGFRβ/VEGF-A | Light chain variable region | Cluster # 1317 | US20110177074 SEQ ID NO: 94 | 9268 |
| OC598 | PDGFRβ/VEGF-A | Light chain variable region | Cluster # 1322 | US20110177074 SEQ ID NO: 98 | 9269 |
| OC599 | PDGFRβ/VEGF-A | Light chain variable region | Cluster # 597 | US20110177074 SEQ ID NO: 6 | 9259 |

TABLE 11-continued

| | | Ocular Disease Antibodies | | | |
|---|---|---|---|---|---|
| Antibody No. | Target | Description | Antibody Name | Reference Information | SEQ ID NO |
| OC600 | RGMa | Light chain variable region | AE12-15 | US20140023659 SEQ ID NO: 103 | 3358 |
| OC601 | RGMa | Light chain variable region | AE12-20 | US20140023659 SEQ ID NO: 111 | 3359 |
| OC602 | RGMa | Light chain variable region | AE12-21 | US20140023659 SEQ ID NO: 119 | 3360 |
| OC603 | RGMa | Light chain variable region | AE12-23 | US20140023659 SEQ ID NO: 127 | 3361 |
| OC604 | RGMa | Light chain variable region | AE12-2 | US20140023659 SEQ ID NO: 13 | 3362 |
| OC605 | RGMa | Light chain variable region | AE12-24 | US20140023659 SEQ ID NO: 135 | 3363 |
| OC606 | RGMa | Light chain variable region | AE12-3 | US20140023659 SEQ ID NO: 21 | 3364 |
| OC607 | RGMa | Light chain variable region | AE12-4 | US20140023659 SEQ ID NO: 29 | 3365 |
| OC608 | RGMa | Light chain variable region | AE12-5 | US20140023659 SEQ ID NO: 37 | 3366 |
| OC609 | RGMa | Light chain variable region | AE12-6 | US20140023659 SEQ ID NO: 45 | 3367 |
| OC610 | RGMa | Light chain variable region | AE12-1 | US20140023659 SEQ ID NO: 5 | 3368 |
| OC611 | RGMa | Light chain variable region | AE12-7 | US20140023659 SEQ ID NO: 53 | 3369 |
| OC612 | RGMa | Light chain variable region | AE12-8 | US20140023659 SEQ ID NO: 61 | 3370 |
| OC613 | RGMa | Light chain variable region | AE12-13 | US20140023659 SEQ ID NO: 95 | 3371 |
| OC614 | S1P4 | Light chain variable region | | WO2015057939 SEQ ID NO: 9 | 4431 |
| OC615 | VEGF, C5, Factor P, Factor D, EPO, EPOR, IL-1β, IL-17A, Il-10, TNFα, or FGFR2 | Light chain variable region | NVS73 | US20140186350 SEQ ID 120 | 17853 |
| OC616 | VEGF, C5, Factor P, Factor D, EPO, EPOR, IL-1β, IL-17A, Il-10, TNFα, or FGFR2 | Light chain variable region | NVS4 | US20140186350 SEQ ID 17 | 17854 |
| OC617 | VEGF, C5, Factor P, Factor D, EPO, EPOR, IL-1β, IL-17A, Il-10, TNFα, or FGFR2 | Light chain variable region | NVS75 | US20140186350 SEQ ID 201 | 17855 |
| OC618 | VEGF, C5, Factor P, Factor D, EPO, EPOR, IL-1β, IL-17A, Il-10, TNFα, or FGFR2 | Light chain variable region | NVS70 | US20140186350 SEQ ID 49 | 17856 |
| OC619 | VEGF, C5, Factor P, Factor D, EPO, EPOR, IL-1β, IL-17A, Il-10, TNFα, or FGFR2 | Light chain variable region | NVS71 | US20140186350 SEQ ID 71 | 17857 |
| OC620 | VEGF, C5, Factor P, Factor D, EPO, EPOR, IL-1β, IL-17A, Il-10, TNFα, or FGFR2 | Light chain variable region | NVS72 | US20140186350 SEQ ID 93 | 17858 |
| OC621 | VEGF-A | Light chain variable region | L3 | US20140086829 SEQ ID NO: 8 | 9350 |
| OC622 | C5a | Light chain with signal peptide | BNJ364, BNJ367, BNJ366, BNJ369 | US20130224187 SEQ ID 16 | 9466 |
| OC623 | C5a | Light chain with signal peptide | BNJ371, BNJ381 | US20130224187 SEQ ID 35 | 9467 |

TABLE 11-continued

Ocular Disease Antibodies

| Antibody No. | Target | Description | Antibody Name | Reference Information | SEQ ID NO |
|---|---|---|---|---|---|
| OC624 | C5a | Light chain with signal peptide | BNJ378, BNJ383 | US20130224187 SEQ ID 39 | 9468 |
| OC625 | VEGF-A | scFv | L3H6 | US20140086829 SEQ ID NO: 10 | 9617 |
| OC626 | VEGF-A | scFv | L3H5 | US20140086829 SEQ ID NO: 12 | 9618 |
| OC627 | VEGF-A | scFv | L3H7 | US20140086829 SEQ ID NO: 14 | 9619 |
| OC628 | VEGF-A | scFv | Fab L3H6 | US20140086829 SEQ ID 17 | 9620 |
| OC629 | VEGF-A | scFv | Fab L3H6 | US20140086829 SEQ ID 18 | 9621 |
| OC630 | VEGF-A | scFv | Fab L3H5 | US20140086829 SEQ ID 21 | 9622 |
| OC631 | VEGF-A | scFv | Fab L3H5 | US20140086829 SEQ ID 22 | 9623 |
| OC632 | VEGF-A | scFv | Fab L3H7 | US20140086829 SEQ ID 25 | 9624 |
| OC633 | Annexin IV or a phospholipid; and (b) a complement inhibitor | scoff | B4 | WO2014116880 SEQ ID 17 | 9630 |
| OC634 | Annexin IV or a phospholipid; and (b) a complement inhibitor | scFV | B4 | WO2014116880 SEQ ID 18 | 9631 |
| OC635 | Annexin IV or a phospholipid; and (b) a complement inhibitor | scFV | C2 | WO2014116880 SEQ ID 37 | 9632 |
| OC636 | Annexin IV or a phospholipid; and (b) a complement inhibitor | scFV | C2 | WO2014116880 SEQ ID 38 | 9633 |
| OC637 | VEGF, C5, Factor P, Factor D, EPO, EPOR, IL-1β, IL-17A, Il-10, TNFα, or FGFR2 | single chain | NVS78 | US20140186350 SEQ ID 146 | 17859 |
| OC638 | VEGF, C5, Factor P, Factor D, EPO, EPOR, IL-1β, IL-17A, Il-10, TNFα, or FGFR2 | single chain | NVS78T | US20140186350 SEQ ID 147 | 17860 |
| OC639 | VEGF, C5, Factor P, Factor D, EPO, EPOR, IL-1β, IL-17A, Il-10, TNFα, or FGFR2 | single chain | NVS90 | US20140186350 SEQ ID 148 | 17861 |
| OC640 | VEGF, C5, Factor P, Factor D, EPO, EPOR, IL-1β, IL-17A, Il-10, TNFα, or FGFR2 | single chain | NVS90T | US20140186350 SEQ ID 149 | 17862 |
| OC641 | VEGF, C5, Factor P, Factor D, EPO, EPOR, IL-1β, IL-17A, Il-10, TNFα, or FGFR2 | single chain | NVS79 | US20140186350 SEQ ID 150 | 17863 |
| OC642 | VEGF, C5, Factor P, Factor D, EPO, EPOR, IL-1β, IL-17A, Il-10, TNFα, or FGFR2 | single chain | NVS79T | US20140186350 SEQ ID 151 | 17864 |

TABLE 11-continued

Ocular Disease Antibodies

| Antibody No. | Target | Description | Antibody Name | Reference Information | SEQ ID NO |
|---|---|---|---|---|---|
| OC643 | VEGF, C5, Factor P, Factor D, EPO, EPOR, IL-1β, IL-17A, Il-10, TNFα, or FGFR2 | single chain | NVS91 | US20140186350 SEQ ID 152 | 17865 |
| OC644 | VEGF, C5, Factor P, Factor D, EPO, EPOR, IL-1β, IL-17A, Il-10, TNFα, or FGFR2 | single chain | NVS91T | US20140186350 SEQ ID 153 | 17866 |
| OC645 | VEGF, C5, Factor P, Factor D, EPO, EPOR, IL-1β, IL-17A, Il-10, TNFα, or FGFR2 | single chain | NVS80 | US20140186350 SEQ ID 154 | 17867 |
| OC646 | VEGF, C5, Factor P, Factor D, EPO, EPOR, IL-1β, IL-17A, Il-10, TNFα, or FGFR2 | single chain | NVS80T | US20140186350 SEQ ID 156 | 17868 |
| OC647 | VEGF, C5, Factor P, Factor D, EPO, EPOR, IL-1β, IL-17A, Il-10, TNFα, or FGFR2 | single chain | NVS83 | US20140186350 SEQ ID 165 | 17869 |
| OC648 | VEGF, C5, Factor P, Factor D, EPO, EPOR, IL-1β, IL-17A, Il-10, TNFα, or FGFR2 | single chain | NVS83T | US20140186350 SEQ ID 166 | 17870 |
| OC649 | VEGF, C5, Factor P, Factor D, EPO, EPOR, IL-1β, IL-17A, Il-10, TNFα, or FGFR2 | single chain | NVS84 | US20140186350 SEQ ID 167 | 17871 |
| OC650 | VEGF, C5, Factor P, Factor D, EPO, EPOR, IL-1β, IL-17A, Il-10, TNFα, or FGFR2 | single chain | NVS84T | US20140186350 SEQ ID 168 | 17872 |
| OC651 | VEGF, C5, Factor P, Factor D, EPO, EPOR, IL-1β, IL-17A, Il-10, TNFα, or FGFR2 | single chain | NVS85 | US20140186350 SEQ ID 169 | 17873 |
| OC652 | VEGF, C5, Factor P, Factor D, EPO, EPOR, IL-1β, IL-17A, Il-10, TNFα, or FGFR2 | single chain | NVS85T | US20140186350 SEQ ID 170 | 17874 |
| OC653 | TGFbeta | single-domain | DOM23h-33 | WO2011012609 SEQ ID 1 | 9655 |
| OC654 | TGFbeta | single-domain | DOM23h-439 | WO2011012609 SEQ ID 10 | 9656 |
| OC655 | TGFbeta | single-domain | DOM23h-440 | WO2011012609 SEQ ID 11 | 9657 |
| OC656 | TGFbeta | single-domain | DOM23h-262-6 | WO2011012609 SEQ ID 12 | 9658 |
| OC657 | TGFbeta | single-domain | DOM23h-262-10 | WO2011012609 SEQ ID 13 | 9659 |
| OC658 | TGFbeta | single-domain | DOM23h-271-3 | WO2011012609 SEQ ID 14 | 9660 |
| OC659 | TGFbeta | single-domain | DOM23h-271-7 | WO2011012609 SEQ ID 15 | 9661 |

TABLE 11-continued

Ocular Disease Antibodies

| Antibody No. | Target | Description | Antibody Name | Reference Information | SEQ ID NO |
|---|---|---|---|---|---|
| OC660 | TGFbeta | single-domain | DOM23h-271-12 | WO2011012609 SEQ ID 16 | 9662 |
| OC661 | TGFbeta | single-domain | DOM23h-271-13 | WO2011012609 SEQ ID 17 | 9663 |
| OC662 | TGFbeta | single-domain | DOM23h-437-4 | WO2011012609 SEQ ID 18 | 9664 |
| OC663 | TGFbeta | single-domain | DOM23h-437-6 | WO2011012609 SEQ ID 19 | 9665 |
| OC664 | TGFbeta | single-domain | DOM23h-251 | WO2011012609 SEQ ID 2 | 9666 |
| OC665 | TGFbeta | single-domain | DOM23h-437-8 | WO2011012609 SEQ ID 20 | 9667 |
| OC666 | TGFbeta | single-domain | DOM23h-437-9 | WO2011012609 SEQ ID 21 | 9668 |
| OC667 | TGFbeta | single-domain | DOM23h-439-6 | WO2011012609 SEQ ID 22 | 9669 |
| OC668 | TGFbeta | single-domain | DOM23h-439-8 | WO2011012609 SEQ ID 23 | 9670 |
| OC669 | TGFbeta | single-domain | DOM23h-262 | WO2011012609 SEQ ID 3 | 9671 |
| OC670 | TGFbeta | single-domain | DOM23h-271 | WO2011012609 SEQ ID 4 | 9672 |
| OC671 | TGFbeta | single-domain | DOM23h-348 | WO2011012609 SEQ ID 5 | 9673 |
| OC672 | TGFbeta | single-domain | DOM23h-435 | WO2011012609 SEQ ID 6 | 9674 |
| OC673 | TGFbeta | single-domain | DOM23h-436 | WO2011012609 SEQ ID 7 | 9675 |
| OC674 | TGFbeta | single-domain | DOM23h-437 | WO2011012609 SEQ ID 8 | 9676 |
| OC675 | TGFbeta | single-domain | DOM23h-438 | WO2011012609 SEQ ID 9 | 9677 |
| OC676 | VEGFA | | Brolucizumab, ESBA-1008, ESBA1008, | | 17875 |

Systemic Disease Antibodies

In one embodiment, the payload region of the AAV particle comprises one or more nucleic acid sequences encoding one or more of the systemic disease payload antibody polypeptides listed in Table 12 (SYS1-SYS73; SEQ ID NO: 7124, 7127, 7291-7293, 9394, 9397, 9485-9487, 17876-47938).

TABLE 12

Systemic Disease Antibodies

| Antibody No. | Target | Description | Antibody Name | Reference Information | SEQ ID NO |
|---|---|---|---|---|---|
| SYS1 | integral αIIbβ3, GPIIb/IIIa | Chain A, Antibody for platelet aggregation | Tadocizumab, C4G1, YM-337 | U.S. Pat. No. 5,777,085 SEQ ID NO: 23 | 17876 |
| SYS2 | integrin αIIbβ3, GPIIb/IIIa | Chain B, Antibody for platelet aggregation | Tadocizumab, C4G1, YM-337 | U.S. Pat. No. 5,777,085 SEQ ID NO: 12 | 17877 |
| SYS3 | | Fab fragment | Tadocizumab | | 17878 |
| SYS4 | | Fab fragment | Tadocizumab | | 17879 |
| SYS5 | | Fusion protein | Sotatercept | | 17880 |
| SYS6 | selectin P | Heavy chain | Inclacumab, LC1004-002, RO4905417 | | 17881 |
| SYS7 | | Heavy chain | Alirocumab | | 17882 |
| SYS8 | | Heavy chain | Abciximab | | 17883 |
| SYS9 | | Heavy chain | Bococizumab | | 17884 |
| SYS10 | | Heavy chain | Evinacumab | | 17885 |
| SYS11 | | Heavy chain | Inclacumab | | 17886 |
| SYS12 | | Heavy chain | Lanadelumab | | 17887 |
| SYS13 | | Heavy chain | Ralpancizumab | | 17888 |
| SYS14 | | Heavy chain | Roledumab | | 17889 |
| SYS15 | CD20 | Heavy Chain, Antibody for | Idarucizumab | U.S. Pat. No. 8,486,398 SEQ ID NO: 35; | 17890 |

TABLE 12-continued

Systemic Disease Antibodies

| Antibody No. | Target | Description | Antibody Name | Reference Information | SEQ ID NO |
|---|---|---|---|---|---|
| | | reversing anticoagulation of dabigatran | | U.S. Pat. No. 8,486,398 SEQ ID NO: 39 | |
| SYS16 | oxLDL | Heavy chain Antibody for acute coronary syndrome, atherosclerosis | Orticumab, BI-204, MLDL-1278A, R7418, RG-7418 | | 17891 |
| SYS17 | | Heavy chain Fab fragment | Idarucizumab | | 17892 |
| SYS18 | selectin P | Heavy chain variable region | Inclacumab, LC1004-002, RO4905417 | U.S. Pat. No. 7,563,441 SEQ ID NO: 4 | 17893 |
| SYS19 | oxLDL | Heavy chain variable region, Antibody for acute coronary syndrome, atherosclerosis | Orticumab, Bi-204, MLDL-1278A, R7418, RG-7418 | U.S. Pat. No. 8,318,161 SEQ ID NO: 3 | 7124 |
| SYS20 | C5 | Heavy Chain Variable Region, Antibody for cardiopulmonary bypass, myocardial infection, h5g1.1VHC + F | Pexelizumab, 5G1.1-SC | | 17894 |
| SYS21 | PCSK9 | Heavy chain variable region, Antibody for cholesterol | Alirocumab | U.S. Pat. No. 8,062,640 SEQ ID NO: 90 | 17895 |
| SYS22 | TNFSF11 | Heavy Chain Variable Region, Antibody for osteoporosis | Denosumab, Prolia | U.S. Pat. No. 7,364,736; U.S. Pat. No. 8,058,418; U.S. Pat. No. 8,409,578 | 7127 |
| SYS23 | TFPI | Heavy chain, Antibody for bleeding, | Concizumab, Anti-TFPI, NN7415, mab2021 | U.S. Pat. No. 8,361,469 SEQ ID NO: 24 | 17896 |
| SYS24 | PCSK9 | Heavy chain Antibody for cardiovascular disease | Bococizumab | U.S. Pat. No. 8,399,646 SEQ ID NO: 15 | 17897 |
| SYS25 | PCSK9 | Heavy cliain, Antibody for cholesterol | Alirocumab | | 17898 |
| SYS26 | PCSK9 | Heavy chain, Antibody for dyslipidemia, Hypercholesterolemia | Ralpancizumab, PF-05335810, RN317 | | 17899 |
| SYS27 | F9, F10 | Heavy chain, Antibody for hematology (hemophilia), anti 10 | Emicizumab, ACE910, hBS910 | | 17900 |
| SYS28 | F9, F10 | Heavy chain, Antibody for hematology (hemophilia), anti F-91 | Emicizumab, ACE910, hBS910 | | 17901 |
| SYS29 | PCSK9 | Heavy chain, Antibody for hypercholesterolemia | Lodelcizumab, LGT209, NVP-LGT209 | | 17902 |
| SYS30 | PCSK9 | Heavy chain, Antibody for hyperlipidemia | Evolocumab | U.S. Pat. No. 8,030,457 | 17903 |
| SYS31 | ANGPTL3 | Heavy chain, Antibody for Hypertriglyceridemia | Evinacumab, REGN 1500 | | 17904 |
| SYS32 | TNFSF11 | Heavy Chain, Antibody for osteoporosis | Denosumab, Prolia | U.S. Pat. No. 7,364,736; U.S. Pat. No. 8,058,418; U.S. Pat. No. 8,409,578 | 7292 |
| SYS33 | SOST | Heavy chain, Antibody for osteoporosis, | Romosozumab | U.S. Pat. No. 7,592,429; U.S. Pat. No. 7,872,106; U.S. Pat. No. 8,003,108: U.S. Pat. No. 8,017,120 SEQ ID NOs: 147, 145 | 17905 |

TABLE 12-continued

| Antibody No. | Target | Description | Antibody Name | Reference Information | SEQ ID NO |
|---|---|---|---|---|---|
| SYS34 | SOST | Heavy chain, Antibody for osteoporosis, | Blosozumab | U.S. Pat. No. 7,744,874 SEQ ID NO: 3 | 7291 |
| SYS35 | TNFSF11 | Heavy chain, Antibody for osteoporosis, Denosumab αOPGL-1 | Denosumab, Prolia | U.S. Pat. No. 8,962,807 SEQ ID NO: 177; U.S. Pat. No. 7,528,236 SEQ ID NO: 28 | 7293 |
| SYS36 | RHD | Heavy chain, Antibody for prevention of fetomaternal alloimmunization in RhD women | Roledumab, LFB-R593, DMATRIA™ | WO 2010100383 | 17906 |
| SYS37 | CD20 | Heavy Chain, Antibody for reversing anticoagulation of dabigatran | Idarucizumab | U.S. Pat. No. 8,486,398 SEQ ID NO: 38; U.S. Pat. No. 8,486,398 SEQ ID NO: 41; U.S. Pat. No. 8,486,398 SEQ ID NO: 36 | 17907 |
| SYS38 | | hemophilia | Factor IX-Fc antibody | US20050147618 SEQ ID NO: 23 | 17908 |
| SYS39 | | hemophilia | Factor VIII-Fc antibody | WO2011069164 SEQ ID NO: 2 | 17909 |
| SYS40 | selectin P (a5b1) | Light chain | Inclacumab, LC1004-002, RO4905418 | U.S. Pat. No. 8,039,596 SEQ ID NO: 10; U.S. Pat. No. 7,432,359 SEQ ID NO: 89 | 17910 |
| SYS41 | | Light chain | Alirocumab | | 17911 |
| SYS42 | | Light chain | Abciximab | | 17912 |
| SYS43 | | Light chain | Bococizumab | | 17913 |
| SYS44 | | Light chain | Evinacumab | | 17914 |
| SYS45 | | Light chain | Idarucimab | | 17915 |
| SYS46 | | Light chain | Inclacumab | | 17916 |
| SYS47 | | Light chain | Lanadelumab | | 17917 |
| SYS48 | | Light chain | Ralpancizumab | | 17918 |
| SYS49 | | Light chain | Roledumab | | 17919 |
| SYS50 | ANGPTL3 | Light chain, Antibody for Hypertriglyceridemia | Evinacumab, REGN 1500 | | 17920 |
| SYS51 | CD41 7E3 | Light chain 1, Antibody for preventing blood clot, ReoPro-Like | Abciximab, c7E3 Fab, ReoPro | U.S. Pat. No. 5,275,812; U.S. Pat. No. 5,770,198; U.S. Pat. No. 5,440,020 | 17921 |
| SYS52 | CD41 7E3 | Light chain 1, Antibody for preventing blood clot, ReoPro-Like | Abciximab, c7E3 Fab, ReoPro | U.S. Pat. No. 5,275,812; U.S. Pat. No. 5,770,198; U.S. Pat. No. 5,440,020 | 17922 |
| SYS53 | selectin P | Light chain variable region | Inclacumab, LC1004-002, RO4905417 | U.S. Pat. No. 7,563,441 SEQ ID NO: 3 | 17923 |
| SYS54 | oxLDL | Light chain variable region, Antibody for acute coronary syndrome, atherosclerosis | Orticumab, Bi-204, MLDL-1278A, R7418, RG-7418 | U.S. Pat. No. 8,318,161 SEQ ID NO: 4 | 9394 |
| SYS55 | C5 | Light Chain Variable Region, Antibody for cardiopulmonary bypass, myocardial infection, h5g1.1VHC + F | Pexelizumab, 5G1.1-SC | | 17924 |
| SYS56 | PCSK9 | Light chain variable region, Antibody for cholesterol | Alirocumab | U.S. Pat. No. 8,062,640 SEQ ID NO: 92 | 17925 |
| SYS57 | TNFSF11 | Light Chain Variable Region, Antibody for osteoporosis | Denosumab, Prolia | U.S. Pat. No. 7,364,736; U.S. Pat. No. 8,058,418; U.S. Pat. No. 8,409,578 | 9397 |
| SYS58 | oxLDL | Light chain, Antibody for acute coronary syndrome, atherosclerosis | Orticumab, BI-204, MLDL-1278A, R7418, RG-7418 | | 17926 |

TABLE 12-continued

Systemic Disease Antibodies

| Antibody No. | Target | Description | Antibody Name | Reference Information | SEQ ID NO |
|---|---|---|---|---|---|
| SYS59 | PCSK9 | Light chain, Antibody for blood, hypercholesterolemia | Lodelcizumab, LGT209, NVP-LGT209 | U.S. Pat. No. 8,710,192 SEQ ID NO: 17 | 17927 |
| SYS60 | PCSK9 | Light chain, Antibody for cardiovascular disease | Bococizumab | U.S. Pat. No. 8,399,646 SEQ ID NO: 14 | 17928 |
| SYS61 | PCSK9 | Light chain, Antibody for cholesterol | Alirocumab | | 17929 |
| SYS62 | PCSK9 | Light chain, Antibody for dyslipidemia, Hypercholesterolemia | Ralpancizumab, PF-05335810, RN317 | | 17930 |
| SYS63 | F9, F10 | Light chain, Antibody for hematology (hemophilia) | Emicizumab, ACE910, hBS910 | | 17931 |
| SYS64 | TFPI | Light chain, Antibody for hemophilia, | Concizumab, Anti-TFPI, NN7415, mab2021 | U.S. Pat. No. 8,361,469 SEQ ID NO: 21 | 17932 |
| SYS65 | PCSK9 | Light chain, Antibody for hyperlipidemia | Evolocumab | U.S. Pat. No. 8,030,457 SEQ ID NO: 297 | 17933 |
| SYS66 | TNFSF11 | Light Chain, Antibody for osteoporosis | Denosumab, Prolia | U.S. Pat. No. 7,364,736; U.S. Pat. No. 8,058,418; U.S. Pat. No. 8,409,578 | 9486 |
| SYS67 | SOST | Light chain, Antibody for osteoporosis, | Romosozumab | U.S. Pat. No. 7,592,429; U.S. Pat. No. 7,872,106; U.S. Pat. No. 8,003,108; U.S. Pat. No. 8,017,120 SEQ ID NOs: 141, 143 | 17934 |
| SYS68 | SOST | Light chain, Antibody for osteoporosis, | Blosozumab | U.S. Pat. No. 7,744,874 SEQ ID NO: 6 | 9485 |
| SYS69 | TNFSF11 | Light chain, Antibody for osteoporosis, Denosumab αOPGL-1 | Denosumab, Prolia | U.S. Pat. No. 8,992,925 SEQ ID NO: 8; U.S. Pat. No. 7,364,736 SEQ ID NO: 4 | 9487 |
| SYS70 | RHD | Light chain, Antibody for prevention of fetomaternal alloimmunization in RhD women | Roledumab, LFB-R593, DMATRIA ™ | WO 2010100383 | 17935 |
| SYS71 | | Peptide | Ecallantide | | 17936 |
| SYS72 | C5 | scFv, Antibody for cardiopulmonary bypass, myocardial infection, h5g1.1 | Pexelizumab, 5G1.1-SC | | 17937 |
| SYS73 | | | Abaloparatide | | 17938 |

In one embodiment, the payload region of the AAV particle comprises a nucleic acid sequence encoding a polypeptide which is an antibody, an antibody-based composition, or a fragment thereof. As a non-limiting example, the antibody may be one or more of the polypeptides listed in Tables 3-12. As another non-limiting example, the antibody may be one or more of the heavy chain sequences listed in Tables 3-12. As a non-limiting example, the antibody may be one or more of the light chain sequences listed in Table 3-12.

In one embodiment, the payload region of the AAV particle comprises a nucleic acid sequence encoding a polypeptide comprising a heavy chain and a light chain sequence listed in Tables 3-12. The payload region may also comprise a linker between the heavy and light chain sequences. The linker may be a sequence known in the art or described in Table 2.

In one embodiment, the payload region of the AAV particle comprises a nucleic acid sequence encoding a polypeptide comprising a heavy chain and a light chain sequence listed in Tables 3-12, where the heavy chain sequence is from a different antibody than the light chain sequence. The payload region may also comprise a linker between the heavy and light chain sequences. The linker may be a sequence known in the art or described in Table 2.

In one embodiment, the payload region comprises, in the 5' to 3' direction, an antibody light chain sequence, a linker and a heavy chain sequence.

In one embodiment, the payload region comprises a nucleic acid sequence encoding, in the 5' to 3' direction, an antibody light chain sequence from Tables 3-12, a linker from Table 2 and a heavy Chain sequence from Tables 3-12.

In one embodiment, the payload region comprises, in the 5' to 3' direction, an antibody heavy chain sequence, a linker and a light chain sequence.

In one embodiment, the payload region comprises a nucleic acid sequence encoding, in the 5' to 3' direction, an antibody heavy chain sequence from Tables 3-12, a linker from Table 2 and a light chain sequence from Tables 3-12.

In one embodiment, the payload region comprises a nucleic acid sequence encoding a single heavy chain. As a non-limiting example, the heavy chain is an amino acid sequence or fragment thereof described in Tables 3-12.

Shown in Tables 3-12 are a listing of antibodies and their polynucleotides and/or poly peptides sequences. These sequences may be encoded by or included in the AAV particles of the present invention. Variants or fragments of the antibody sequences described in Tables 3-12 may be utilized in the AAV particles of the present invention.

In some embodiments, the AAV particles may comprise codon-optimized versions of the nucleic acids encoding the polypeptides listed in Tables 3-12. In some cases, the payload region of the AAV particles of the invention may encode one or more isoforms or variants of these heavy and light chain antibody domains. Such variants may be humanized or optimized antibody domains comprising one or more complementarity determining regions (CDRs) from the heavy and light chains listed in Tables 3-12. Methods of determining CDRs are well known in the art and are described herein. Payload regions may encode antibody variants with one or more heavy chain variable domain ($V_H$) or light chain variable domain ($V_L$) derived from the antibody sequences in Tables 3-12. In some cases, such variants may include bispecific antibodies. Bispecific antibodies encoded by payload regions of the invention may comprise variable domain pairs from two different antibodies.

In one embodiment, the AAV particles may comprise a heavy and a light chain of an antibody described herein and two promoters. As a non-limiting example, the AAV particles may comprise a nucleic acid sequence of a genome as described in. FIG. 1 or FIG. 2 of US Patent Publication No. US20030219733, the contents of which are herein incorporated by reference in its entirety. As another non-limiting example, the AAV particles may be a dual-promoter AAV for antibody expression as described by Lewis et al. (J. of. Virology, September 2002, Vol. 76(17), p 8769-8775; the contents of which are herein incorporated by reference in its entirety).

Disease Specific Epitopes, Innate Defense Regulator Peptides, Cyclic Peptides

In one embodiment, the viral genomes of the AAV particles may comprise nucleic acids which have been engineered to enable expression of antibodies binding to disease-specific epitopes of proteins. Such antibodies may be used to diagnose, prevent, and/or treat the corresponding medical conditions by targeting epitopes of the protein presented by or accessible on native or non-native forms (e.g., misfolded forms of native proteins) of the target. Such epitopes may be specific to diseases involved with misfolding of a protein due to pathologic condition and resulting in misfolded aggregates. The disease-specific proteins are considered to be toxic to neurons and to have a role in neuronal cell death and dysfunction in neurodegenerative diseases including, but not limited to, Alzheimer's disease (AD), amyotrophic lateral sclerosis (ALS), Parkinson's disease, dementia by Lewy body (DLB), and priori diseases, e.g. Creutzfeldt-Jakob disease (CID), Gerstmann-Straussier-Scheinker syndrome (GSS), kuru, and fatal familial insomnia (FFI).

In one embodiment, the encoded disease-specific epitopes may include epitopes on SOD1 that are revealed as SOD1. (Superoxide dismutase [Cu—Zn]) dissociates from its homodimeric, normal state. The SOD epitopes may be selectively presented or accessible in non-native SOD1 forms including misfolded SOD1 monomer, misfolded SOD1 dimer, and the epitopes selectively presented or accessible in SOD1 aggregates. Such epitopes ma be specific to neurodegenerative diseases including, but not limited to, amyotrophic lateral sclerosis (ALS), Alzheimer's (AD), Parkinson's (PD), and Lewy body diseases (LBD).

In one embodiment, the expressed antibodies may bind to epitopes presented by or accessible on non-native forms of SOD1, such as those presented by SEQ ID NO: 2, 3, 5, 6, and 7 of U.S. Pat. No. 7,977,314 (the contents of which are herein incorporated by reference in its entirety), or presented h or accessible on monomeric forms of SOD1, such as those presented by SEQ ID NOs: 1 and 4 of U.S. Pat. No. 7,977,314, the contents of which are herein incorporated by reference in their entirety. In one embodiment, the expressed antibodies may comprise isolated peptides corresponding to such epitopes, such as those presented in SEQ ID NOs: 1-8 or SEQ ID NOs: 8-16, or epitopes presented by SEQ ID NOs: 34-63, 65-79 of U.S. Pat. No. 7,977,314, the contents of which are herein incorporated by reference in their entirety.

In one embodiment, the encoded disease-specific epitopes nay be specific to diseases associated with prion protein (PrP); familial amyloid polyneuropathy or senile systemic amyloidosis or a disease related by the presence of misfolded transthyretine (TTR); renal accumulation of β2 microglobulin amyloid deposits or a disease related by the presence of misfolded β2 microglobulin, amyotrophic lateral sclerosis (ALS) or a disease related by the presence of misfolded SOD1; leukemias or myelomas or a disease related by the presence of misfolded cluster of differentiation 38 (CD38); colon cancer metastasis and or a disease related by the presence of misfolded cluster of differentiation (CD44), tumors associated with tumor necrosis factor receptor (TNFR); cancers including cervical, head and neck, endometrial, lung and breast carcinomas, pleural mesotheliomas, malignant melanomas, Hodgkin lymphomas, anaplastic large cell non-Hodgkin lymphomas, or a disease related by the presence of misfolded Notch homolog 1 (NOTCH1) e.g. acute myeloid leukemias and B-cell chronic lymphoid leukemias; cancer in which Fas receptor (FasR) is implicated; cancers and related disorders in which misfolded epidermal growth factor (EGFR) is implicated; and/or other related diseases, disorders and conditions.

In one embodiment, the encoded disease specific epitopes may include epitopes that are revealed as the proteins misfold. In one embodiment, the expressed antibodies may bind to predicted epitopes of human PrP, such as those presented by SEQ ID NOs: 1-10 of US Patent Publication No. US20100233176; bovine PrP, such as those presented by SEQ ID NOs: 11-15 of US Patent Publication No. US20100233176, TTI, such as those presented by SEQ ID NOs: 16-22 of US Patent Publication No. US20100233176; beta-2 microglobulin, such as those presented by SEQ ID NOs: 23-26 of US Patent Publication No. US20100233176; SOD1 such as those presented by SEQ ID NOs: 27-40 of US Patent Publication No. US20100233176; CD38, such as those presented by SEQ ID NOs: 41-45 of US Patent Publication No. US20100233176, CD44, such as those presented by 46-50 of US Patent Publication No. US20100233176; TNFR, such as those presented by 51-55 of US Patent Publication No. US20100233176; notch protein, such as those presented in SEQ ID NOs: 56-60 of US Patent Publication No. US20100233176; FasR, such as those presented by SEQ ID NOs: 61-65 of US Patent Publication No. US20100233176 and EGFR, such as those presented by SEQ ID NOs: 66-80 of US Patent Publication No. US20100233176; the contents of which are herein incorporated by reference in their entirety.

In one embodiment, the expressed antibodies may comprise peptides corresponding to such epitopes. In one embodiment, the expressed antibodies may comprise prion-specific peptides, such as those presented by SEQ ID NOs: 81-88 of US Patent Publication No. US20100233176, the contents of which are herein incorporated by reference in their entirety, and variations thereof.

In one embodiment, the encoded disease-specific epitopes may be specific to prion diseases, including transmissible spongiform encephalopathies (TSEs) or other prion diseases. In one embodiment, the expressed antibodies may bind to predicted epitopes of PrP, such as those presented by SEQ ID NOs: 24, 26, 28, 30, 32, 34, 36, 39-43, of US Patent Publication No. US20150004185, the contents of which are herein incorporated by reference in their entirety. In one embodiment, the expressed antibodies may comprise prion-specific peptides or peptide fusions, such as those presented by SEQ ID NOs: 12-23, 25, 27, 29, 31, 33, 35, 37, 38, 43, and 44-48 of US Patent Publication No. US20150004185, the contents of which are herein incorporated by reference in their entirety.

In one embodiment, the expressed antibodies may comprise prion peptides binding to prion specific abnormal isoform of the prion protein, such as those presented by SEQ ID NOs: 2-10 of US Patent Publication No. US20040072236, the contents of which are herein incorporated by reference in their entirety.

In one embodiment, the viral genomes of the AAV particles may comprise nucleic acids which have been engineered to express innate defense regulator (IDR) peptides. IDRs are immunomodulatory peptides that act directly on cells to effect an innate immune response. Such IDRs may be used to treat neurodegenerative diseases associated with neuroinflammation, e.g. amyotrophic lateral sclerosis (ALS), Alzheimer's disease, Friedreich's ataxia, Huntington's disease, Lewy body disease, Parkinson's disease, spinal muscular atrophy, and multiple sclerosis (MS) and other neurodegenerative diseases. In one embodiment, IDRs may be those presented by SEQ ID NOS: 1-969, and 973-1264 of International Publication No. WO2013034982, the contents of which are herein incorporated by reference in their entirety, or analogs, derivatives, amidated variations and conservative variations thereof.

In one embodiment, the viral genomes of the AAV particles may comprise nucleic acids which have been engineered to express antibodies binding to an epitope of the Tropomyosin receptor kinase (TrkC) receptor. Such antibodies may comprise a peptide, such as one presented by SEQ ID NO: 1 of U.S. Pat. No. 9,200,080, the contents of which are herein incorporated by reference in their entirety.

In some embodiments, the viral genomes of the AAV particles may comprise nucleic acids which have been engineered to express cyclic peptides with an amino acid sequence SNK. Non-limiting examples of other cyclic peptides include SEQ ID NO: 1-7 of U.S. Pat. No. 9,216,217, the contents of which are herein incorporated by reference in their entirety. The method of preparing the antibodies may include hyperimmune preparation method, as described in U.S. Pat. No. 9,216,217, the contents of which are herein incorporated by reference in their entirety.

Prions

In one embodiment, the viral genomes of the AAV particles may comprise a nucleic acid sequence encoding antibodies comprising prion peptides comprising prion epitopes, and fusions and repeats thereof such as those presented by SEQ ID NOs: 8-32, 35, and 36 of U.S. Pat. No. 9,056,918, the contents of which are herein incorporated by reference in their entirety.

In one embodiment, the viral genomes of the AAV particles may comprise a nucleic acid sequence encoding prion binding proteins (PrPBP). In one embodiment, the PrPBPs are cadherins, such as those presented by SEQ ID NOs: 1 and 2 of International Publication WO1997/045746, the contents of which are herein incorporated by reference in their entirety. In one embodiment, the PrPBPs are cadherins, such as those presented by SEQ NOs: 2 and 7-9 of International Publication No. WO2001000235, the contents of which are herein incorporated by reference in their entirety.

The Nature of the Polypeptides and Variants

Antibodies encoded by payload regions of the viral genomes of the invention may be translated as a whole polypeptide, a plurality of polypeptides or fragments of polypeptides, which independently may be encoded by one or more nucleic acids, fragments of nucleic acids or variants of any of the aforementioned. As used herein, "polypeptide" means a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogy, fragments and other equivalents, variants, and analogs of the foregoing. A polypeptide may be a single molecule or may be a multi-molecular complex such as a dimer, trimer or tetramer. They may also comprise single chain or raultichain polypeptides and may be associated or linked. The term polypeptide may also apply to amino acid polymers in which one or more amino acid residues are an artificial chemical analogue of a corresponding naturally occurring amino acid.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" is one which contains one or more amino acids which would mimic an activated sequence. For example, glutamate may serve as a mimic for phosphoro-threonine and/or phosphoro-serine. Alternatively, variant may result in deactivation or in an inactivated product, containing the mimic, phenylalanine may act as an inactivating substitution for tyrosine; or alanine may act as an inactivating substitution for serine.

The term "amino acid sequence variant" refers to molecules with some differences in their amino acid sequences as compared to a native or starting sequence. The amino acid sequence variants may possess substitutions, deletions, and/or insertions at certain positions within the amino acid sequence. "Native" or "starting" sequence should not be confused with a wild type sequence. As used herein, a native or starting sequence is a relative term referring to an original molecule against which a comparison may be made.

"Native" or "starting" sequences or molecules may represent the wild-type (that sequence found in nature) but do not have to be the wild-type sequence.

Ordinarily, variants will possess at least about 70% homology to a native sequence, and preferably, they will be at least about 80%, more preferably at least about 90% homologous to a native sequence. "Homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

By "homologs" as it applies to amino acid sequences is meant the corresponding sequence of other species having substantial identity to a second sequence of a second species.

"Analogs" is meant to include polypeptide variants which differ by one or more amino acid alterations, e.g., substitutions, additions or deletions of amino acid residues that still maintain the properties of the parent polypeptide.

Sequence tags or amino acids, such as one or more lysines, can be added to the peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

"Insertional variants" when referring to proteins are those with one or more amino acids inserted immediately adjacent to an amino acid at a particular position in a native or starting sequence. "Immediately adjacent" to an amino acid means connected to either the alpha-carboxy or alpha-amino functional group of the amino acid.

"Deletional variants" when referring to proteins, are those with one or more amino acids in the native or starting amino acid sequence removed. Ordinarily, deletional variants will have one or more amino acids deleted in a particular region of the molecule.

As used herein, the term "derivative" is used synonymously with the term "variant" and refers to a molecule that has been modified or changed in any way relative to a reference molecule or starting molecule. In some embodiments, derivatives include native or starting proteins that have been modified with an organic proteinaceous or non-proteinaceous derivatizing agent, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biolottical activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the proteins used in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties), W. H. Freeman & Co., San Francisco, pp. 79-86 (1983)).

"Features" when referring to proteins are defined as distinct amino acid sequence-based components of a molecule. Features of the proteins of the present invention include surface manifestations, local conformational shape, folds loops, half-loops, domains, half-domains, sites, termini or any combination thereof.

As used herein when referring to proteins the term "surface manifestation" refers to a polypeptide based component of a protein appearing on an outermost surface.

As used herein when referring to proteins the term "local conformational shape" means a poly peptide based structural manifestation of a protein which is located within a definable space of the protein.

As used herein when referring to proteins the term "fold" means the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein the term "turn" as it relates to protein conformation means a bend which alters the direction of the backbone of a peptide or polypeptide and may involve one, two, three or more amino acid residues.

As used herein when referring to proteins the term "loop" refers to a structural feature of a peptide or poly peptide which reverses the direction of the backbone of a peptide or polypeptide and comprises four or more amino acid residues. Oliva et al. have identified at least 5 classes of protein loops (J. Mol Biol 266 (4): 814-830; 1997).

As used herein when referring to proteins the term "half-loop" refers to a portion of an identified loop having at least half the number of amino acid residues as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2−3.5+/−0.5 being 3 or 4).

As used herein when referring to proteins the term "domain" refers to a motif of a polypeptide having one or more identifiable structural or functional characteristics or properties (e.g., binding capacity, serving as a site for protein-protein interactions).

As used herein when referring to proteins the term "half-domain" means portion of an identified domain having at least half the number of amino acid residues as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2−3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein when referring to proteins the terms "site" as it pertains to amino acid based embodiments is used synonymous with "amino acid residue" and "amino acid side chain". A site represents a position within a peptide or polypeptide that may be modified, manipulated, altered, derivatized or varied within the polypeptide bared molecules of the present invention.

As used herein the terms "termini or terminus" when referring to proteins refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the care may be, with a non-polypeptide based moiety such as an organic conjugate.

Once any of the features have been identified or defined as a component of a molecule of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involves deleting a domain would result in the alteration of the length of a molecule just as modification of a nucleic acid to encode less than a full length molecule would.

Modifications and manipulations can be accomplished by methods known in the art such as site directed mutagenesis. The resulting modified molecules may then be tested for activity using in vitro or in vivo assays such as those described herein or any other suitable screening assay known in the art.

AAV Production

The present invention provides methods for the generation of parvoviral particles. e.g. AAV particles, by viral genome replication in a viral replication cell.

In accordance with the invention, the viral genome comprising a payload region encoding an antibody, an antibody-based composition or fragment thereof, will be incorporated into the AAV particle produced in the viral replication cell. Methods of making AAV particles are well known in the art and are described in e.g., U.S. Pat. Nos. 6,204,059, 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508, 5,064,764, 6,194,191, 6,566,118, 8,137,948; or International Publication Nos. WO1996039530, WO1998010088, WO1999014354, WO1999015685, WO1999047691, WO2000055342, WO2000075353 and WO2001023597; Methods in Molecular Biology, ed. Richard, Humana Press, N.J. (1995); O'Reilly et al., Baculovirus Expression Vectors, A Laboratory Manual, Oxford Univ. Press (1994); Samulski et al, J. Vir. 63:3822-8 (1989); Kajigaya et al., Proc. Nat'l. Acad. Sci. USA 88: 4646-50 (1991); Ruffing et al., J. Vir. 66:6922-30 (1992); Kimbauer et al. Vir. 219:37444 (1996); Zhao et al., Vir. 272:382-93 (2000); the contents of each of which are herein incorporated by reference in their entirety. In one embodiment, the AAV particles are made using the methods described in WO2015191508, the contents of which are herein incorporated by reference in their entirety.

Viral replication cells commonly used for production of recombinant AAV viral vectors include but are not limited to 293 cells, COS cells, HeLa cells, KB cells, and other mammalian cell lines as described in U.S. Pat. Nos. 6,156,303, 5,387,484, 5,741,683, 5,691,176, and 5,688,676; U.S. patent publication No. 2002/0081721, and International Patent Publication Nos. WO 00/47757, WO 00/24916, and WO 96/17947, the contents of each of which are herein incorporated by reference in their entireties.

In some embodiments, the present invention provides a method for producing an AAV particle having enhanced (increased, improved) transduction efficiency comprising the steps of: 1) co-transfecting competent bacterial cells with a bacmid vector and either a viral construct vector and/or AAV payload construct vector, 2) isolating the resultant viral construct expression vector and AAV payload construct expression vector and separately transsecting viral replication cells, 3) isolating and purifying resultant payload and viral construct particles comprising viral construct expression vector or AAV payload construct expression vector, 4) co-infecting a viral replication cell with both the AAV payload and viral construct particles comprising viral construct expression vector or AAV payload construct expression vector, and 5) harvesting and purifying the AAV particle comprising a viral genome.

In some embodiments, the present invention provides a method for producing an AAV particle comprising the steps of 1) simultaneously co-transfecting mammalian cells, such as, hut not limited to HEK293 cells, with a payload region, a construct expressing rep and cap genes and a helper construct, 2) harvesting and purifying the AAV particle comprising a viral genome.

In some embodiments, the viral genome of the AAV particle of the invention optionally encodes a selectable marker. The selectable marker may comprise a cell-surface marker, such as any protein expressed on the surface of the cell including, but not limited to receptors, CD markers, lectins, integrins, or truncated versions thereof.

In some embodiments, selectable marker reporter genes as described in International application No. WO 96/23810; Heim et al., Current Biology 2:178-182 (1996); Heim et al., Proc. Natl. Acad. Sci. USA (1995); or Heim et al., Science 373:663-664 (1995), WO 96/30540, the contents of each of which are incorporated herein by reference in their entireties).

II. Formulation and Delivery

Pharmaceutical Compositions

According to the present invention the AAV particles may be prepared as pharmaceutical compositions. It will be understood that such compositions necessarily comprise one or more active ingredients and, most often, a pharmaceutically acceptable excipient.

Relative amounts of the active ingredient (e.g. AAV particle), a pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g. between 0.5 and 50%, between 1-30%, between 5-80%, at least 80% (w/w) active ingredient.

In some embodiments, the AAV particle pharmaceutical compositions described herein may comprise at least one payload. As a non-limiting example, the pharmaceutical compositions may contain an AAV particle with 1, 2, 3, 4 or 5 payloads. In one embodiment, the pharmaceutical composition may contain a nucleic acid encoding a payload construct encoding proteins selected from antibodies and/or antibody-based compositions.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, rats, birds, including commercially relevant birds such as poultry, chickens, ducks, geese, and/or turkeys.

In some embodiments, compositions are administered to humans, human patients or subjects.

Formulations

The AAV particles of the invention can be formulated using one or more excipients to: (1) increase stability; (2) increase cell transfection or transduction; (3) permit the sustained or delayed expression of the payload; (4) alter the biodistribution (e.g., target the viral particle to specific tissues or cell types); (5) increase the translation of encoded protein; (6) alter the release profile of encoded protein and/or (7) allow for regulatable expression of the payload.

Formulations of the present invention can include, without limitation, saline, liposomes, lipid nanoparticles, polymers, peptides, proteins, cells transfected with viral vectors (e.g., for transfer or transplantation into a subject) and combinations thereof.

Formulations of the pharmaceutical compositions described herein may be prepared by any method known or hereafter developed in the art of pharmacology. As used herein the term "pharmaceutical composition" refers to compositions comprising at least one active ingredient and optionally one or more pharmaceutically acceptable excipients.

In general, such preparatory methods include the step of associating the active ingredient with an excipient and/or one or more other accessory ingredients. As used herein, the phrase "active ingredient" generally refers either to an AAV particle carrying, a payload region encoding the polypeptides of the invention or to the antibody or antibody-based composition encoded by a viral genome of by an AAV particle as described herein.

Formulations of the AAV particles and pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

In one embodiment, the AAV particles of the invention may be formulated in PBS with 0.001% of pluronic acid (F-68) at a pH of about 7.0.

Relative amounts of the active ingredient (e.g. AAV particle), the pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the AAV formulations described herein may contain sufficient AAV particles for expression of at least one expressed functional antibody or antibody-based composition. As a non-limiting example, the AAV particles may contain viral genomes encoding 1, 3, 4 or 5 functional antibodies.

According to the present invention AAV particles may be formulated for CNS delivery. Agents that cross the brain blood barrier may be used. For example, some cell penetrating peptides that can target molecules to the brain blood barrier endothelium may be used for formulation (e.g., Mathupala, *Expert Opin Ther Pat.*, 2009, 19, 137-140; the content of which is incorporated herein by reference in its entirety).

Excipients and Diluents

The AAV particles of the invention can be formulated using one or more excipients or diluents to (1) increase stability; (2) increase cell transfection or transduction; (3) permit the sustained or delayed release; (4) alter the biodistribution (e.g., target the viral particle to specific tissues or cell types); (5) increase the translation of encoded protein in vivo; (6) alter the release profile of encoded protein in vivo and/or (7) allow for regulatable expression of the polypeptides of the invention.

In some embodiments, a pharmaceutically acceptable excipient may be at least 95%, at least 96%, at least 97%, at least 98%, at least 99%, or 100% pure. In some embodiments, an excipient is approved for use for humans and for veterinary use. In some embodiments, an excipient may be approved by United States Food and Drug Administration. In some embodiments, an excipient may be of pharmaceutical grade. In some embodiments, an excipient may meet the standards of the United States Pharmacopoeia (USP), the European Pharmacopoeia (EP), the British Pharmacopoeia, and/or the international Pharmacopoeia.

Excipients, as used herein, include, but are not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21st Edition, A. R. Gepriaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Inactive Ingredients

In some embodiments, AAV particle formulations may comprise at least one inactive ingredient. As used herein, the term "inactive ingredient" refers to one or more agents that do not contribute to the activity of the active ingredient of the pharmaceutical composition included in formulations. In some embodiments, all, none or some of the inactive ingredients which may be used in the formulations of the present invention may be approved by the US Food and Drug Administration (FDA).

In one embodiment, the AAV particle pharmaceutical compositions comprise at least one inactive ingredient such as, but not limited to, 1,2,6-Hexanetriol; 1,2-Dimyristoyl-Sn-Glycero-3-(Phospho-S-(1-Glycerol)); 1,2-Dimyristoyl-Sn-Glycero-3-Phosphocholine; 1,2-Dioleoyl-Sn-Glycero-3-Phosphocholine; 1,2-Dipalmitoyl-Sn-Glycero-3-(Phospho-Rac-(1-Glycerol)); 1,2-Distearoyl-Sn-Glycero-3-(Phospho-Rac-(1-Glycerol)); 1,2-Distearoyl-Sn-Glycero-3-Phosphocholine; 1-O-Tolylbiguanide, 2-Ethyl-1,6-Hexanediol, Acetic Acid; Acetic Acid, Glacial; Acetic Anhydride; Acetone; Acetone Sodium Bisuffile; Acetylated Lanolin Alcohols, Acetylated Monoglycerides; Acetylcysteine; Acetyltryptophan, DL-; Acrylates Copolymer; Acrylic Acid-Isooctyl Acrylate Copolymer; Acrylic Adhesive 788; Activated Charcoal; Adcote 72A103; Adhesive Tape; Adipic Acid; Aerotex Resin 3730; Alanine; Albumin Aggregated; Albumin Colloidal; Albumin Human; Alcohol; Alcohol, Dehydrated; Alcohol, Denatured; Alcohol, Diluted; Alfadex; Alginic Acid; Alkyl Ammonium Sulfonic Acid Betaine; Alkyl Aryl Sodium Sulfonate; Allantoin; Allyl Alpha-Ionone; Almond Oil; Alpha-Terpineol; Alpha-Tocopherol; Alpha-Tocopherol Acetate, Dl-; Alpha-Tocopherol, Dl-; Aluminum Acetate; Aluminum Chlorhydroxy Allantoinate; Aluminum Hydroxide; Aluminum Hydroxide-Sucrose, Hydrated; Aluminum Hydroxide Gel; Aluminum Hydroxide Gel F 500, Aluminum Hydroxide Gel F 5000; Aluminum Monostearate; Aluminum Oxide; Aluminum Polyester; Aluminum Silicate; Aluminum Starch Octenylsuccinate; Aluminum Stearate; Aluminum Subacetate; Aluminum Sulfate Anhydrous; Amerchol C; Amerchol-Cab; Aminomethylpropanol; Ammonia; Ammonia Solution; Ammonia Solution, Strong; Ammonium Acetate; Ammonium Hydroxide; Ammonium Laurel Sulfate; Ammonium Nonoxynol-4 Sulfate; Ammonium Salt Of C-12-C-15 Linear Primary Alcohol Ethoxylate; Ammonium Sulfate; Ammonyx; Amphoteric-2; Amphoteric-9; Anethole; Anhydrous Citric Acid; Anhydrous Dextrose; Anhydrous Lactose; Anhydrous Trisodium Citrate; Aniseed Oil; Anoxid Sbn; Antifoam; Antipyrine; Apaflurane; Apricot Kernel Oil Peg-6 Esters; Aquaphor; Arginine; Arlacel; Ascorbic Acid; Ascorbyl Palmitate; Aspartic Acid; Balsam Peru; Barium Sulfate; Beeswax; Beeswax, Synthetic; Beheneth-10; Bentonite; Benzalkonium Chloride; Benzenesulfonic Acid; Benzethonium Chloride; Benzododecinium Bromide; Benzoic Acid; Benzyl Alcohol; Benzyl Benzoate; Benzyl Chloride; Betadex; Bibapcitide; Bismuth Subgallate; Boric Acid; Brocrinal; Butane; Butyl Alcohol; Butyl Ester Of Vinyl Methyl Ether/Maleic Anhydride Copolymer (125000 Mw); Butyl Stearate; Bulylated Hydroxyanisole; Bulylated Hydroxytoluene; Butylene Glycol; Butylparaben; Butyric Acid; C20-40 Pareth-24; Caffeine; Calcium; Calcium Carbonate; Calcium Chloride; Calcium Gluceptate; Calcium Hydroxide; Calcium Lactate; Calcobutrol; Caldiamide Sodium; Caloxetate Trisodium; Calteridol Calcium; Canada Balsam; Caprylic/Capric Triglyceride; Caprylic/Capric/Stearic Triglyceride;

Captan; Captisol; Caramel; Carbomer 1342; Carbomer 1382; Carbomer 934; Carbomer 934p; Carbomer 940; Carbomer 941; Carbomer 980; Carbomer 981; Carbomer Homopolymer Type B (Allyl Pentaerythritol Crosslinked); Carbomer Homopolymer Type C (Allyl Pentaerythritol Crosslinked); Carbon Dioxide; Carboxy Vinyl Copolymer; Carboxymeticellulose; Carboxymethylcellulose Sodium; Carboxypolymethylene; Carrageenan; Carrageenan Salt; Castor Oil; Cedar Leaf Oil; Cellulose; Cellulose. Microcrystalline; Cerasynt-Se; Ceresin; Ceteareth-12; Ceteareth-15; Ceteareth-30; Cetearyl Alcohol/Ceteareth-20; Cetearyl Ethylhexanoate; Ceteth-10; Ceteth-2; Ceteth-20 Ceteth-23; Cetostearyl Alcohol; Cetrimonium Chloride; Cetyl Alcohol; Cetyl Esters Wax; Cetyl Palmitate; Cetylpyridium Chloride; Chlorobutanol; Chlorobutanol Hemihydrate; Chlorobutanol, Anhydrous; Chlorocresol; Chloroxylenol; Cholesterol; Choleth; Choleth-24; Citrate; Citric Acid; Citric Acid Monohydrate; Citric Acid, Hydrous; Cocamide Ether Sulfate; Cocamine Oxide; Coco Betaine; Coco Diethanolamide; Coco Monoethanolamide; Cocoa Butter; Coco-Glycerides; Coconut Oil; Coconut Oil, Hydrogenated: Coconut Oil/Palm Kernel Oil Glycerides, Hydrogenated; Cocoyl Caprylocaprate: Cola Nitida Seed Extract; Collagen; Coloring Suspension; Corn Oil; Cottonseed Oil; Cream Base; Creatine; Creatinine; Cresol; Croscarmellose Sodium; Crospovidone; Cupric Sulfate; Cupric Sulfate Anhydrous; Cyclomethicone; Cyclomethicone/Dimethicone Copolyol, Cysteine; Cysteine Hydrochloride; Cysteine Hydrochloride Anhydrous; Cysteine, Dl-; D&C Red No. 28; D&C Red No. 33; D&C Red No. 36; D&C Red No. 39; D&C Yellow No. 10; Dalfampridine; Daubert 1-5 Pestr (Matte) 164z; Decyl Methyl Sulfoxide; Dehydag Wax Sx: Dehydroacetic Acid; Dehymuls E; Denatonium Benzoate; Deoxycholic Acid; Dextran; Dextran 40; Dextrin; Dextrose; Dextrose Monohydrate; Dextrose Solution; Diatrizoic Acid; Diazolidinyl Urea; Dichlorobenzyl Alcohol; Dichlorodifluoromethane; Dichlorotetralluoroethane; Diethanolamine; Diethyl Pyrocarbonate; Diethyl Sebacate; Diethylene Glycol Monoethyl Ether; Diethylhexyl Phthalate; Dihydroxyaluminum Aminoacetate; Diisopropanolamine; Diisopropyl Adipate; Diisopropyl Dilinoleate; Dimethicone 350; Dimethicone Copolyol; Dimethicone Mdx4-4210; Dimethicone Medical Fluid 360; Dimethyl isosorbide; Dimethyl Sulfoxide; Dimethylaminoethyl Methacrylate-Butyl Methacrylate-Methyl Methacrylate Copolymer; Dimethyldioctadecylammonium Bentonite; Dimethylsiloxane/Methylvinylsiloxane Copolymer; Dinoseb Ammonium Salt; Dipalmitoylphosphatidylglycerol, Dl-; Dipropylene Glycol; Disodium Cocoamphodiacelate; Disodium Laureth Sulfosuccinate; Disodium Lauryl Sulfosuccinate; Disodium Sulfosalicylate; Disofenin; Divinylbenzene Styrene Copolymer; Dmdm Hydantoin; Docosanol; Docusate Sodium; Duro-Tak 280-2516; Duro-Tak 387-2516; Duro-Tak 80-1196; Duro-Tak 87-2070; Duro-Tak 87-2194; Duro-Tak 87-2287; Duro-Tak 87-2296; Duro-Tak 87-2888; Duro-Tak 87-2979; Edetate Calcium Disodium; Edetate Disodium; Edetate Disodium Anhydrous; Edetate Sodium; Edetic Acid; Egg Phospholipids; Entsufon; Entsufon Sodium; Epilactose; Epitetracycline Hydrochloride; Essence Bouquet 9200; Ethanolamine Hydrochloride; Ethyl Acetate; Ethyl Oleate; Ethylcelluloses, Ethylene Glycol; Ethylene Vinyl Acetate Copolymer; Ethylenediamine; Ethylenediamine Dihydrochloride; Ethylene-Propylene Copolymer; Ethylene-Vinyl Acetate Copolymer (28% Vinyl Acetate); Ethylene-Vinyl Acetate Copolymer (9% Vinylacetate); Ethylhexyl Hydroxystearate; Ethylparaben; Eucalyptol, Exametazine, Fat, Edible; Fat. Hard; Fatty Acid Esters; Fatty Acid Pentaerythriol Ester; Fatty Acids; Fatty Alcohol Citrate; Fatty Alcohols; Fd&C Blue No, 1; Fd&C Green No. 3; Fd&C Red No. 4; Fd&C Red No. 40; Fd&C Yellow No. 10 (Delisted); Fd&C Yellow No. 5; Fd&C Yellow No. 6; Ferric Chloride; Ferric Oxide; Flavor 89-186; Flavor 89-259; Flavor Df-119; Flavor Df-1530; Flavor Enhancer; Flavor Fig 827118; Flavor Raspberry Pfc-8407; Flavor Rhodia Pharmaceutical No. Rf 451; Fluorochlorohydrocarbons; Formaldehyde; Formaldehyde Solution; Fractionated Coconut Oil; Fragrance 3949-5; Fragrance 520a; Fragrance 6.007; Fragrance 91-122; Fragrance 9128-Y; Fragrance 93498g; Fragrance Balsam Pine No. 5124; Fragrance Bouquet 10328; Fragrance Chemodem 6401-B; Fragrance Chemoderm 6411; Fragrance Cream No, 73457: Fragrance Cs-28197: Fragrance Felton 066m: Fragrance Firmenich 47373; Fragrance Givaudan Ess 9090/1c; Fragrance H-6540; Fragrance Herbal 10396; Fragrance Nj-1085; Fragrance P O Fl-147; Fragrance Pa 52805; Fragrance Pera Derm D; Fragrance Rhd-9819; Fragrance Shaw Mudge U-7776; Fragrance Tf 044078; Fragrance Ungerer Honeysuckle K 2771; Fragrance Lingerer N5195; Fructose; Gadolinium Oxide; Galactose; Gamma Cs clodextrin; Gelatin; Gelatin, Crosslinked; Gelfoam Sponge; Gellan Gum (Low Acyl); Gelva 737; Gentisic Acid; Gentisic Acid Ethanolamide; Gluceptate Sodium; Gluceptate Sodium Dihydrate; Gluconolactone: Glucuronic Acid; Glutamic Acid, Dl-; Glutathione; Glycerin; Glycerol Ester Of Hydrogenated Rosin; Glyceryl Citrate; Glyceryl Isostearate; Glyceryl Laurate; Glyceryl Monostearate; Glyceryl Oleate; Glyceryl Oleate/Propylene Glycol; Glyceryl Palmitate; Glyceryl Ricinoleate; Glyceryl Stearate; Glyceryl Stearate-Laureth-23; Glyceryl Stearate/Pep. Stearate; Glyceryl Stearate/Peg-100 Stearate; Glyceryl Stearate/Peg-40 Stearate; Glyceryl Stearate-Stearamidoethyl Diethylamine; Glyceryl Trioleate; Glycine; Glycine Hydrochloride Distearate; Glycol Stearate; Guanidine Hydrochloride; Guar Gum; Hair Conditioner (18n195-1m); Heptane; Hetastarch; Hexylene Glycol; High Density Polyethylene; Histidine; Human Albumin Microspheres; Hyaluronate Sodium; Hydrocarbon; Hydrocarbon Gel, Plasticized; Hydrochloric Acid; Hydrochloric Acid, Diluted; Hydrocortisone; Hydrogel Polymer; Hydrogen Peroxide; Hydrogenated Castor Oil; Hydrogenated Palm Oil; Hydrogenated Palm/Palm Kernel Oil Peg-6 Esters; Hydrogenated Polybutene 635-690; Hydroxide Ion; Hydroxyethyl Cellulose; Hydroxyethylpiperazine Ethane Sulfonic Acid; Hydroxymethyl Cellulose; Hydroxyoctacosanyl Hydroxystearate; Hydroxypropyl Cellulose; Hydroxypropyl Methylcellulose 2906; Hydroxypropyl-Beta-cyclodextrin; Hypromellose 2208 (15000 Mpa·S); Hypromellose 2910 (15000 Mpa·S); Hypromelloses; Imidurea; Iodine; Iodoxamic Acid; Iofetamine Hydrochloride; Irish Moss Extract; Isobutane; Isoceteth-20; Isoleucine; Isooctyl Acrylate; Isopropyl Alcohol; Isopropyl Isostearate; Isopropyl Myristate; Isopropyl Myristate Myristyl Alcohol; Isopropyl Palmitate; Isopropyl Stearate; Isostearic Acid; Isostearyl Alcohol; Isotonic Sodium Chloride Solution; Jelene; Kaolin; Kathon Cg; Kathon Cg II; Lactate; Lactic Acid; Lactic Acid, Dl-; Lactic Acid, L-; Lactobionic Acid; Lactose; Lactose Monohydrate; Lactose, Hydrous: Laneth; Lanolin; Lanolin Alcohol-Mineral Oil; Lanolin Alcohols; Lanolin Anhydrous: Lanolin Cholesterols; Lanolin Nonionic Derivatives; Lanolin, Ethoxylated; Lanolin, Hydrogenated; Lauralkonium Chloride; Lauramine Oxide; Laurdimonium Hydrolyzed Animal Collagen; Laureth Sulfate; Laureth-2; Laureth-23; Laureleth-4; Laurie Diethanolamide; Laurie Myristic Diethanolamide; Lauroyl Sarcosine; Lauryl Lactate; Lauryl Sulfate; Larandula Angustifolia Flowering Top; Lecithin; Lecithin Unbleached; Lecithin, Egg; Lecithin, Hydrogenated; Lecithin, Hydrogenated Soy; Lecithin, Soybean; Lemon Oil: Leucine: Levulinic Acid; Lidofenin; Light Mineral Oil; Light Mineral Oil (85 Ssu); Limonene, (+/−); Lipocol Sc-15; Lysine; Lysine Acetate; Lysine Monohydrate: Magnesium Aluminum Silicate: Magnesium Aluminum Silicate Hydrate; Magnesium Chloride; Magnesium Nitrate; Magnesium Stearate; Maleic Acid: Mannitol; Maprofix; Mebrofenin; Medical Adhesive Modified S-15; Medical Antiform A-F Emulsion; Medronate Disodium; Medronic Acid; Meglumine; Menthol; Metacresol; Metaphosphoric Acid; Methartesulfonic Acid: Methionine; Methyl Alcohol; Methyl Gluceth-10; Methyl Gluceth-20; Methyl Gluceth-20 Sesquistearate; Methyl Glucose Sesquistearate; Methyl Laurate; Methyl Pyrrolidone; Methyl Salicylate; Methyl Stearate; Methylboronic Acid; Methylcellulose (4000 Mpa·S); Methyl celluloses; Methyldiloroisothiazolinorte; Methylene Blue: Methylisothiazolinone; Methylparaben; Microcrystalline Wax: Mineral Oil; Mono and Diglyceride; Monostearyl Citrate; Monothioglycerol; Multisterol Extract; Myristyl Alcohol; Myristyl Lactate; Myristyl-.Gamma.-Picolinium Chloride; N-(Carbarnoyl-Methoxy Peg-40)-1,2-Distearoyl-Cephalin Sodium; N,N-Dimethylacetamide; Niacinamide: Nioxime; Nitric Acid; Nitrogen; Nonoxynol Iodine; Nonoxynol-15; Nonoxvnol-9; Norflurane: Oatmeal: Octadecene-1/Maleic Acid Copolymer; Octanoic Acid; Octisalate; Octoxynol-1; Octoxynol-40; Octoxynol-9; Octyldodecanol; Octylphenol Poly-methylene; Oleic Acid; Oleth-10/Oleth-5; Oleth-2; Oleth-20; Oleyl Alcohol; Oleyl Oleate; Olive Oil; Oxidronate Disodium; Oxoquinoline; Palm Kernel Oil; Palmitamine Oxide; Parabens; Paraffin; Paraffin, White Soft; Parfum Creme 45/3; Peanut Oil; Peanut Oil, Refined; Pectin; Peg 6-32 Stearate/Glycol Stearate; Peg Vegetable Oil; Peg-100 Stearate; Peg-12 Glyceryl Laurate; Peg-120 Glyceryl Stearate; Peg-120 Methyl Glucose Dioleate; Peg-15 Cocamine; Peg-150 Distearate; Peg-2 Stearate; Peg-20 Sorbitan Isostearate; Peg-22 Methyl Ether/Dodecyl Glycol Copolymer; Peg-25 Propylene Glycol Stearate; Peg-4 Dilaurate; Pea-4 Laurate; Peg-40 Castor Oil; Peg-40 Sorbitan Diisostearate; Peg-45/Dodecyl Glycol Copolymer; Peg-5 Oleate; Peg-50 Stearate; Peg-54 Hydrogenated Castor Oil: Peg-6 Esostearate; Peg-60 Castor Oil; Peg-60 Hydrogenated Castor Oil; Peg-7 Methyl Ether; Peg-75 Lanolin; Peg-8 Laurate; Peg-8 Stearate; Pegoxol 7 Stearate; Pentadecalactone; Pentaerythritol Cocoate; Pentasodium Pentetate; Pentetate Calcium Trisodium; Pentetic Acid; Peppermint Oil; Perflutren; Perfume 25677: Perfume Bouquet; Perfume E-1991; Perfume Gd 5604; Perfume Tana 90/42 Scba; Perfume W-1952-1; Petrolatum; Petrolatum; White; Petroleum Distillates; Phenol; Phenol, Liquefied; Phenonip; Phenoxyethanol; Phenylalanine; Phenylethyl Alcohol; Phenylmercuric Acetate; Phenylinercuric Nitrate; Phosphatidyl Glycerol, Egg; Phospholipid; Phospholipid, Egg; Phospholipon 90 g; Phosphoric Acid; Pine Needle Oil (Pinus Sylvestris); Piperazine Hexahydrate; Plastibase-50w; Polacrilin; Polidronium Chloride, Poloxamer 124; Poloxamer 181, Poloxamer 182; Poloxamer 188; Poloxamer 237; Poloxamer 407; Poly(Bis(P-Carboxyphenoxy)Propane Anhydride): Sebacic Acid; Poly(Dimethylsiloxane/Methylvinylsiloxane/Methylhydrogensiloxane) Dimethylvinyl Or Dimethylhydroxy Or Trimethyl Endblocked; Poly(Dl-Lactic-Co-Glycolic Acid), (50:50; Poly (Dl-Lactic-Co-Glycolic Acid), Ethyl Ester Terminated, (50:50; Polyacrylic Acid (250000 Mw); Polybutene (1400 Mw); Polycarbophil; Polyester; Polyester Poly amine Copolymer; Polyester Rayon, Polyethylene Glycol 1000; Polyethylene Glycol 1450; Polyethylene Glycol 1500; Polyethylene Glycol 1540; Polyethylene Glycol 200; Polyethylene Glycol 300; Polyethylene Glycol 300-1600; Polyethylene Glycol 3350; Polyethylene Glycol 400; Polyethylene Glycol 4000; Polyethylene Glycol 540; Polyethylene Glycol 600; Polyethylene Glycol 6000, Polyethylene Glycol 8000; Polyethylene Glycol 900; Polyethylene High Density Containing Ferric Oxide Black (<1%); Polyethylene Low Density Containing Barium Sulfate (20-24%); Polyethylene T; Polyethylene Terephthalate.; Polygla.ctin; Polyglyceryl-3 Oleate; Polyglyceryl-4 Oleate; Polyhydroxyethyl Methacrylate: Polyisobutylene; Polyisobutylene (1100000 Mw); Polyisobutylene (35000 Mw); Polyisobutylene 178-236; Polyisobutylene 241-294; Polyisobutylene 35-39; Polyisobutylene Low Molecular Weight; Polyisobutylene Medium Molecular Weight; Polyisobutylene/Polybutene Adhesive; Polylactide: Polyols; Polyoxyethylene-Polyoxypropylene 1800; Polyoxyethylene Alcohols; Polyoxyethylene Fatty Acid Esters; Polyoxyethylene Propylene; Polyoxyl 20 Cetostearyl Ether; Polyoxyl 35 Castor Oil; Polyoxyl 40 Hydrogenated Castor Oil; Polyoxyl 40 Stearate; Polyoxyl 400 Stearate; Polyoxyl 6 And Polyoxyl 32 Palmitostearate; Polyoxyl Distearate; Polyoxyl Glyceryl Stearate, Polyoxyl Lanolin; Polyoxyl Palmitate; Polyoxyl Stearate; Polypropylene; Polypropylene Glycol; Polyquatemium-10; Polyquaternium-7 (70/30 Acrylamide/Dadinac; Polysiloxane; Polysorbate 20; Polysorbate 40; Polysorbate 60; Polysorbate 65; Polysorbate 80; Polyurethane; Polyvinyl Acetate; Polyvinyl Alcohol; Polyvinyl Chloride; Polyvinyl Chloride-Polyvinyl Acetate Copolymer; Polyvinylpyridine; Poppy Seed Oil; Potash; Potassium Acetate; Potassium Alum; Potassium Bicarbonate; Potassium Bisulfite; Potassium Chloride; Potassium Citrate; Potassium Hydroxide; Potassium Metabisulfite; Potassium Phosphate Dibasic; Potassium Phosphate, Monobasic; Potassium Soap; Potassium Sorbate; Povidone Acrylate Copolymer; Povidone Hydrogel; Povidone K17; Povidone K25; Povidone 1 29/32; Povidone K30; Povidone K90; Povidone K90f, Povidone/Eicosene Copolyriter Povidones; Ppg-12/Smdi Copolymer; Ppg-15 Stearyl Ether; Ppg-20 Methyl Glucose Ether Distearate; Ppg-26 Oleate; Product Wat; Proline; Promulgen D; Promulgen G; Propane; Propellant A-46; Propyl Propylene Carbonate; Propylene Glycol; Propylene Glycol Diacetate; Propylene Glycol Dicaprylate; Propylene Glycol Monolaurate; Propylene Glycol Monopalmitostearate; Propylene Glycol Palmitostearate; Propylene Glycol Ricinoleate; Propylene Cilycol/Diazolidinyl Urea/Methylparaben/Propylparben; Propylparaben; Protamine Sulfate; Protein Hydrolysate; Pvm/Ma Copolymer: Quaternium-15: Quaternium-15 Cis-Form: Quaternium-52: Ra-2397; Ra-3011; Saccharin; Saccharin Sodium; Saccharin Sodium Anhydrous; Safflower Oil; Sd Alcohol 3a; Sd Alcohol 40; Sd Alcohol 40-2; Sd Alcohol 40b; Sepineo P 600: Serine; Sesame Oil; Shea Butter; Silastic Brand Medical Grade Tubing; Silastic Medical AdhesiveSilicone, Type A; Silica, Dental; Silicon; Silicon Dioxide; Silicon Dioxide, Colloidal; Silicone; Silicone Adhesive 4102; Silicone Adhesive 4502; Silicone Adhesive Bio-Psa Q7-4201; Silicone Adhesive Bio-Psa 4301; Silicone Emulsion; Silicone/Polyester Film Strip; Simethicone; Simethicone Emulsion; Sipon Ls 20np; Soda Ash: Sodium Acetate; Sodium Acetate Anhydrous; Sodium Alkyl Sulfate; Sodium Ascorbate; Sodium Benzoate; Sodium Bicarbonate; Sodium Bisulfate; Sodium Bisulfite; Sodium Borate; Sodium Borate Decahydrate; Sodium Carbonate; Sodium Carbonate Decahydrate; Sodium Carbonate Monohydrate; Sodium Cetostearyl Sulfate; Sodium Chlorate; Sodium Chloride; Sodium Chloride Injection; Sodium Chloride Injection, Bacteriostatic; Sodium Cholesteryl Sulfate; Sodium Citrate; Sodium Cocoyl Sarcosinate; Sodium Desoxycholate; Sodium Dithionite; Sodium Dodecylbenzenesulfonate; Sodium Formaldehyde Sulfoxylate; Sodium Gluconate; Sodium Hydroxide; Sodium Hypochlorite; Sodium iodide; Sodium Lactate; Sodium Lactate, L-; Sodium Laureth-2 Sulfate; Sodium Laureth-3 Sulfate; Sodium Laureth-5 Sulfate; Sodium Lauroyl Sarcosinate; Sodium Laurel Sulfate; Sodium Lauryl Sulfoacetate; Sodium Metabisulfite; Sodium Nitrate; Sodium Phosphate; Sodium Phosphate Dihydrate; Sodium Phosphate, Dibasic; Sodium Phosphate, Dibasic, Anhydrous; Sodium Phosphate, Dibasic, Dihydrate; Sodium Phosphate, Dibasic, Dodecahydrate; Sodium Phosphate, Dibasic, Heptahydrate; Sodium Phosphate, Mollobasic; Sodium Phosphate, Monobasic, Anhydrous; Sodium Phosphate, Monobasic, Dihydrate; Sodium Phosphate, Monobasic, Monohydrate; Sodium Poly acrylate (2500000 Mw); Sodium Pyrophosphate; Sodium Pyrrolidone Carboxylate; Sodium Starch Glycolate; Sodium Succinate Hexahydrate; Sodium Sulfate; Sodium Sulfate Anhydrous; Sodium Sulfate Decahydrate; Sodium Sulfite; Sodium Sulfosuccinated Undecyclenic Monoalkylolamide; Sodium Tartrate; Sodium Thioglycolate; Sodium Thiomalate; Sodium Thiosulfate; Sodium Thiosulfate Anhydrous; Sodium Trimetaphosphate; Sodium Xylenesulfonate; Somay 44; Sorbic Acid; Sorbitan; Sorbitan Isostearate; Sorbitan Monolaurate; Sorbitan Monooleate; Sorbitan Monopalmitate; Sorbitan Monostearate; Sorbitan Sesquioleate; Sorbitan Trioleate; Sorbitan Tristearate; Sorbitol; Sorbitol Solution; Soybean Flour; Soybean Oil; Spearmint Oil; Spermaceti; Squalane; Stabilized Oxychloro Complex; Stannous 2-Ethylhexanoate; Stannous Chloride; Stannous Chloride Anhydrous; Stannous Fluoride; Stannous Tartrate, Starch; Starch 1500, Pregelatinized; Starch, Corn; Stearalkonium Chloride; Stearalkonium Hectorite/Propylene Carbonate; Stearamidoethyl Diethylamine; Steareth-10; Steareth-100; Steareth-2: Steareth-20; Steareth-21; Steareth-40; Stearic Acid; Stearic Diethanolamide; Stearoxytrimethylsilane; Steartrimonium Hydrolyzed Animal Collagen; Stearyl Alcohol; Sterile Water For Inhalation; Styrene/Isoprene/Styrene Block Copolymer; Succimer; Succinic Acid; Sucralose; Sucrose; Sucrose Distearate; Sucrose Polyesters; Sulfacetamide Sodium; Sulfobutylether .Beta.-Cyclodextrin; Sulfur Dioxide; Sulfuric Acid; Sulfurous Acid; Surfactol Qs; Tagatose, D-; Talc; Tall Oil; Tallow Glycerides; Tartaric Acid; Tartaric Acid, Dl-; Tenox; Tenox-2; Tert-Butyl Alcohol; Hydroperoxide; Tert-Butylhydroquinone; Tetrakis (2-Methoxyisobutylisocyanide)Copper(I) Tetrafluoroborate; Tetrapropyl Orthosilicate; Tetrofosmin; Theophylline; Thimerosal; Threonine; Thymol; Tin; Titanium Dioxide; Tocopherol; Tocophersolan; Total parenteral nutrition, lipid emulsion; Triacetin; Tricaprylin; Trichloromonofluoromethane; Trideceth-10; Triethanolamine Lauryl Sulfate; Trifluoroacetic Acid; Triglycerides, Medium Chain; Trihydroxystearin; Trilaneth-4 Phosphate; Trilaureth-4 Phosphate; Trisodium Citrate Dihydrate; Trisodium Hedta; Triton 720; Triton X-200; Trolamine; Tromantadine; Tromethamine (TRIS); Tryptophan; Tyloxapol; Tyrosine; Undecylenic Acid; Union 76 Amsco-Res 6038; Urea; Valine; Vegetable Oil; Vegetable Oil Glyceride, Hydrogenated; Vegetable Oil, Hydrogenated; Versetamide; Viscarin; Viscose/Cotton; Vitamin 1E; Wax, Emulsifying; Wecohee Fs; White Ceresin Wax; White Wax; Xanthan Gum; Zinc; Zinc Acetate; Zinc Carbonate; Zinc Chloride; and Zinc Oxide.

Pharmaceutical composition formulations of AAV particles disclosed herein may include cations or anions. In one embodiment, the formulations include metal cations such as, but not limited to, Zn2+, Ca2+, Cu2+, Mn2+, Mg+ and combinations thereof. As a non-limiting example, formulations may include polymers and complexes with a metal cation (See e.g., U.S. Pat. Nos. 6,265,389 and 6,555,525, each of which is herein incorporated by reference in its entirety).

Formulations of the invention may also include one or more pharmaceutically acceptable salts. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, acetic acid, adipate, alcanate, ascorbate, aspartate, benzenesulfonate, benzene sulfonic acid, benzoate, bisulfate, borate, butyrate, camphorate, camphorsulfonate, citrate, cyclopentariepropionate, digluconate, dodecylsulfate, ethanesulfonate, fumarate, glucoheptonate, giycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids.

Solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF) N,N'-dimethylacetamide (DMAC),1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

III. Administration and Dosing

Administration

The AAV particles of the present invention may be administered by any delivery route which results in a therapeutically effective outcome. These include, but are not limited to, enteral (into the intestine), gastroenteral, epidural (into the dura mater), oral (by way of the mouth), transdermal, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intra-arterial (into an artery), intramuscular (into a muscle) intracardiac (into the heart), intraosseous infusion (into the bone marrow), intrathecal (into the spinal canal), intraparenchymal (into brain tissue), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, installation (snorting), sublingual, sublabial, enema, eye drops (onto the conjunctiva), or in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracoronal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

In some embodiments, compositions may be administered in a way which allows them to cross the blood-brain barrier, vascular barrier, or other epithelial barrier. The AAV particles of the present invention may be administered in any suitable form, either as a liquid solution or suspension, as a solid form suitable for liquid solution or suspension in a liquid solution. The AAV particles may be formulated with any appropriate and pharmaceutically acceptable excipient.

In one embodiment, the AAV particles of the present invention may be delivered to a subject via a single route administration.

In one embodiment, the AAV particles of the present invention may be delivered to a subject via a multi-site route of administration. A subject may be administered at 2, 3, 4, 5 or more than 5 sites.

In one embodiment, a subject may be administered the AAV particles of the present invention using a bolus infusion.

In one embodiment, a subject may be administered the AAV particles of the present invention using sustained delivery over a period of minutes, hours or days. The infusion rate may be changed depending on the subject, distribution, formulation or another delivery parameter.

In one embodiment, the AAV particles of the present invention may be delivered by intramuscular delivery route. (See, e.g., U.S. Pat. No. 6,506,379; the content of which is incorporated herein by reference in its entirety). Non-limiting examples of intramuscular administration include an intravenous injection or a subcutaneous injection.

In one embodiment, the AAV particles of the present invention may be delivered by oral administration. Non-limiting examples of oral administration include a digestive tract administration and a buccal administration.

In one embodiment, the AAV particles of the present invention may be delivered by intraocular delivery route. A non-limiting example of intraocular administration include an intravitreal injection.

In one embodiment, the AAV particles of the present invention may be delivered by intranasal delivery route. Non-limiting examples of intranasal delivery include administration of nasal drops or nasal sprays.

In some embodiments, the AAV particles that may be administered to a subject by peripheral injections. Non-limiting examples of peripheral injections include intraperitoneal, intramuscular, intravenous, conjunctival or joint injection. It was disclosed in the art that the peripheral administration of AAV vectors can be transported to the central nervous system, for example, to the motor neurons (e.g., U. S. Patent Publication Nos. 20100240739; and 20100130594; the content of each of which is incorporated herein by reference in their entirety).

In one embodiment, the AAV particles may be delivered by injection into the CSF pathway. Non-limiting examples of delivery to the CSF pathway include intrathecal and intracerebroventricular administration.

In one embodiment, the AAV particles may be delivered by systemic delivery. As a non-limiting example, the systemic delivery may be by intravascular administration.

In one embodiment, the AAV particles of the present invention may be administered to a subject by intracranial delivery (See, e.g., U.S. Pat. No. 8,119,611; the content of which is incorporated herein by reference in its entirety).

In one embodiment, the AAV particles of the present invention may be administered to a subject by intraparenchymal administration.

In one embodiment, the AAV particles of the present invention may be administered to a subject by intramuscular administration.

In one embodiment, the AAV particles of the present invention are administered to a subject and transduce muscle of a subject. As a non-limiting example, the AAV particles are administered by intramuscular administration.

In one embodiment, the AAV particles of the present invention may be administered to a subject by intravenous administration.

In one embodiment, the AAV particles of the present invention may be administered to a subject by subcutaneous administration.

In one embodiment, the AAV particles of the present invention may be administered to a subject by topical administration.

In one embodiment, the AAV particles may be delivered by direct injection into the brain. As a non-limiting example, the brain delivery may be by intrastriatal administration.

In one embodiment, the AAV particles may be delivered by more than one route of administration. As non-limiting examples of combination administrations. AAV particles may be delivered by intrathecal and intracerebroventricular, or by intravenous and intraparenchymal administration.

Parenteral and Injectable Administration

In some embodiments, pharmaceutical compositions, AAV particles of the present invention may be administered parenterally. Liquid dosage forms for oral and parenteral administration include, but are not limited to, pharmaceutically acceptable emulsions, microemuisions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycal, dimethylformamide, oils (in particular, cottonseed, groundnut, corn, germ, olive, castor, and sesame oils), glycerol, tetrahydrofarfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water. Ringer's solution, U.S.P., and isotonic sodium chloride solution. Sterile, fixed oils are conventionally employed as a solvent or suspending medium. For this purpose, any bland fixed oil can be employed including synthetic mono- or diglycerides. Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of active ingredients, it is often desirable to slow the absorption of active ingredients from subcutaneous or intramuscular injections. This may be accomplished by the use of liquid suspensions of crystalline or amorphous material with poor water solubility. The rate of absorption of active ingredients depends upon the rate of dissolution which, in turn, may depend upon crystal size and crystalline form. Alternatively, delayed absorption of a parenterally administered drug form is accomplished by dissolving or suspending the drug in an oil vehicle injectable depot forms are made by forming nucroencapsule matrices of the drug in biodegradable polymers such as polylactide-polyglcolide. Depending upon the ratio of drug to polymer and the nature of the particular polymer employed, the rate of drug release can be controlled. Examples of other biodeuadable polymers include poly(orthoesters) and poly (anhydrides). Depot injectable formulations are prepared by entrapping the drug in liposomes or microemulsions which are compatible with body tissues.

Rectal and Vaginal Administration

In some embodiments, pharmaceutical compositions, AAV particles of the present invention may be administered rectally and/or vaginally. Compositions for rectal or vaginal administration are typically suppositories which can be prepared by mixing compositions with suitable non-irritating excipients such as cocoa butter, polyethylene glycol or a suppository wax which are solid at ambient temperature hut liquid at body temperature and therefore melt in the rectum or vaginal cavity and release the active ingredient.

Oral Administration

In some embodiments, pharmaceutical compositions, AAV particles of the present invention may be administered orally. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, pharmaceutical compositions, AAV particles of the present invention may be formulated for administration topically. The skin may be an ideal target site for delivery as it is readily accessible. Three routes are commonly considered to deliver pharmaceutical compositions, AAV particles of the present invention to the skin: (i) topical application (e.g. for local/regional treatment and/or cosmetic applications); (ii) intradermal injection (e.g. for local/regional treatment and/or cosmetic applications); and (iii) systemic delivery (e.g. for treatment of dermatologic diseases that affect both cutaneous and extracutaneous regions). Pharmaceutical compositions, AAV particles of the present invention can be delivered to the skin by several different approaches known in the art.

In some embodiments, the invention provides for a variety of dressings wound dressings) or bandages (e.g., adhesive bandages) for conveniently and/or effectively carrying out methods of the present invention. Typically dressing or bandages may comprise sufficient amounts of pharmaceutical compositions, AAV particles of the present invention described herein to allow users to perform multiple treatments.

Dosage forms for topical and/or transdermal administration may include ointments, pastes, creams, lotions, gels, powders, solutions, sprays, inhalants and/or patches. Generally, active ingredients are admixed under sterile conditions with pharmaceutically acceptable excipients and/or any needed preservatives and/or buffers. Additionally, the present invention contemplates the use of transdermal patches, which often have the added advantage of providing controlled delivery of pharmaceutical compositions, AAV particles of the present invention to the body. Such dosage forms may be prepared, for example, by dissolving and/or dispensing pharmaceutical compositions, AAV particles in the proper medium. Alternatively, or additionally, rates may be controlled by either providing rate controlling membranes and/or by dispersing pharmaceutical compositions, AAV particles in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 1% to about 10% (v/w) active ingredient, although the concentration of active ingredient may be as high as the solubility limit of the active ingredient in the solvent. Formulations for topical administration may further comprise one or more of the additional ingredients described herein.

Depot Administration

As described herein, in some embodiments, pharmaceutical compositions, AAV particles of the present invention are formulated in depots for extended release. Generally, specific organs or tissues ("target tissues") are targeted for administration.

In some aspects of the invention, pharmaceutical compositions, AAV particles of the present invention are spatially retained within or proximal to target tissues. Provided are methods of providing pharmaceutical compositions, AAV particles, to target tissues of mammalian subjects by contacting target tissues (which comprise one or more target cells) with pharmaceutical compositions, AAV particles, under conditions such that they are substantially retained in target tissues, meaning that at least 10, 20, 30, 40, 50, 60, 70, 80, 85, 90, 95, 96, 97, 98, 99, 99.9, 99.99 or greater than 99.99% of the composition is retained in the target tissues. Advantageously, retention is determined by measuring the amount of pharmaceutical compositions, AAV particles, that enter one or more target cells. For example, at least 1%, 5%, 19%, 20%, 30%, 40%, 50%, 60%, 70%, 89%, 85%, 90%, 95%, 96%, 97%, 98%, 99%, 99.9%, 99.99% or greater than 99.99% of pharmaceutical compositions, AAV particles, administered to subjects are present intracellularly at a period of time following administration. For example, intramuscular injection to mammalian subjects may be performed using aqueous compositions comprising pharmaceutical compositions, AAV particles of the present invention and one or more transfection reagents, and retention is determined by measuring the amount of pharmaceutical compositions, AAV particles, present in muscle cells.

Certain aspects of the invention are directed to methods of providing pharmaceutical compositions, AAV particles of the present invention to a target tissues of mammalian subjects, by contacting target tissues (comprising one or more target cells) with pharmaceutical compositions, AAV particles under conditions such that they are substantially retained in such target tissues. Pharmaceutical compositions. AAV particles comprise enough active ingredient such that the effect of interest is produced in at least one target cell. In some embodiments, pharmaceutical compositions, AAV particles generally comprise one or more cell penetration agents, although "naked" formulations (such as without cell penetration agents or other agents) are also contemplated, with or without pharmaceutically acceptable carriers.

Pulmonary Administration

In some embodiments, pharmaceutical compositions, AAV particles of the present invention may be prepared, packaged, and/or sold in formulations suitable for pulmonary administration. In some embodiments, such administration is via the buccal cavity. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising, dry powder reservoirs to which streams of propellant may be directed to disperse such powder. In some embodiments, self-propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° at atmospheric pressure. Generally, propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to a flavoring agent such as saccharin sodium, a volatile oil, a buffering agent, a surface active agent, and/or a preservative such as methylhydroxy benzoate. Droplets provided by this route of administration may have an average diameter in the range from about 0.1 nm to about 200 nm.

Intranasal, Nasal and Buccal Administration

In some embodiments, pharmaceutical compositions, AAV particles of the present invention may be administered nasally and/or intranasal. In some embodiments, formulations described herein useful for pulmonary delivery may also be useful for intranasal delivery. In some embodiments, formulations for intranasal administration comprise a coarse powder comprising the active ingredient and having an average particle from about 0.2 µm to 500 µm. Such formulations are administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein.

Ophthalmic or Otic Administration

In some embodiments, pharmaceutical compositions, AAV particles of the present invention may be prepared, packaged, and/or sold in formulations suitable for ophthalmic and/or otic administration. Such formulations may, for example, be in the form of eye and/or ear drops including, for example, a 0.1/1.0% (w/w) solution and/or suspension of the active ingredient in aqueous and/or oily liquid excipients. Such drops may further comprise buffering agents, salts, and/or one or more other of any additional ingredients described herein. Other ophthalmically-administrable formulations which are useful include those which comprise active ingredients in microcrystalline form and/or in liposomal preparations. Subretinal inserts may also be used as forms of administration.

Delivery

In one embodiment, the AAV particles or pharmaceutical compositions of the present invention may be administered or delivered using the methods for treatment of disease described in U.S. Pat. No. 8,999,948, or International Publication No. WO2014178863, the contents of which are herein incorporated by reference in their entirety.

In one embodiment, the AAV particles or pharmaceutical compositions of the present invention may be administered or delivered using the methods for delivering gene therapy in Alzheimer's Disease or other neurodegenerative conditions as described in US Application No. 20150126590, the contents of which are herein incorporated by reference in their entirety.

In one embodiment, the AAV particles or pharmaceutical compositions of the present invention may be administered or delivered using the methods for delivery of a CNS gene therapy as described in U.S. Pat. Nos. 6,436,708, and 8,946,152, and International Publication No. WO2015168666, the contents of which are herein incorporated by reference in their entirety.

In one embodiment, the AAV particle or pharmaceutical compositions of the present invention may be administered or delivered using the methods for delivering proteins using AAV vectors described in European Patent Application No. EP2678433, the contents of which are herein incorporated by reference in their entirety.

In one embodiment, the AAV particle or pharmaceutical compositions of the present invention may be administered or delivered using the methods for delivering DNA to the bloodstream described in U.S. Pat. No. 6,211,163, the contents of which are herein incorporated by reference in their entirety.

In one embodiment, the AAV particle or pharmaceutical compositions of the present invention may be administered or delivered using the methods for delivering a payload to the central nervous system described in U.S. Pat. No. 7,588,757, the contents of which are herein incorporated by reference in their entirety.

In one embodiment, the AAV particle or pharmaceutical compositions of the present invention may be administered or delivered using the methods for delivering a payload described in U.S. Pat. No. 8,283,151 the contents of which are herein incorporated by reference in their entirety.

In one embodiment, the AAV particle or pharmaceutical compositions of the present invention may be administered or delivered using the methods for delivering a payload using a glutamic acid decarboxylase (GAD) delivery vector described in International Patent Publication No. WO2001089583, the contents of which are herein incorporated by reference in their entirety.

In one embodiment, the AAV particle or pharmaceutical compositions of the present invention may be administered or delivered using the methods for delivering a payload to neural cells described in International Patent Publication No. WO2012057363, the contents of which are herein incorporated by reference in their entirety.

Delivery to Cells

The present disclosure provides a method of delivering to a cell or tissue any of the above-described AAV particles, comprising contacting the cell or tissue with said AAV particle or contacting the cell or tissue with a formulation comprising said AAV particle, or contacting the cell or tissue with any of the described compositions, including pharmaceutical compositions. The method of delivering the AAV particle to a cell or tissue can be accomplished in vitro, ex vivo, or in vivo.

Delivery to Subjects

The present disclosure additionally provides a method of delivering to a subject, including a mammalian subject, any of the above-described AAV particles comprising administering to the subject said AAV particle, or administering to the subject a formulation comprising said AAV particle, or administering to the subject any of the described compositions, including pharmaceutical compositions.

Dose and Regimen

The present invention provides methods of administering AAV particles in accordance with the invention to a subject in need thereof. The pharmaceutical, diagnostic, or prophylactic AAV particles and compositions of the present invention may be administered to a subject using any amount and any route of administration effective for preventing, treating, managing, or diagnosing diseases, disorders and/or conditions. The exact amount required will vary from subject to subject, depending on the species, age, and general condition of the subject, the severity of the disease, the particular composition, its mode of administration, its mode of activity, and the like. The subject may be a human, a mammal, or an animal. Compositions in accordance with the invention are typically formulated in unit dosage form for ease of administration and uniformity of dosage. It will be understood, however, that the total daily usage of the compositions of the present invention may be decided by the attending physician within the scope of sound medical judgment. The specific therapeutically effective, prophylactically effective, or appropriate diagnostic dose level for any particular individual will depend upon a variety of factors including the disorder being treated and the severity of the disorder; the activity of the specific payload employed; the specific composition employed; the age, body weight, general health, sex and diet of the patient; the time of administration, route of administration, and rate of excretion of the specific AAV particle employed; the duration of the treatment; drugs used in combination or coincidental with the specific AAV particle employed, and like factors well known in the medical arts.

In certain embodiments, AAV particle pharmaceutical compositions in accordance with the present invention may be administered at dosage levels sufficient to deliver from about 0.0001 mg/kg to about 100 mg/kg, from about 0.001 mg/kg to about 0.05 mg/kg, from about 0.005 mg/kg to about 005 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, or prophylactic, effect. It will be understood that the above dosing concentrations may be converted to vg or viral genomes per kg or into total viral genomes administered by one of skill in the art.

In certain embodiments, AAV particle pharmaceutical compositions in accordance with the present disclosure may be administered at about 10 to about 600 µl/site, 50 to about 500 µl/site, 100 to about 400 µl/site, 120 to about 300 µl/site, 140 to about 200 µl/site, about 160 µl/site. As non-limiting examples, AAV particles be administered at 50 µl/site and/or 150 µl/site.

The desired dosage of the AAV particles of the present invention may be delivered only once, three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations). When multiple administrations are employed, split dosing regimens such as those described herein may be used. As used herein, a "split dose" is the division of "single unit dose" or total daily dose into two or more doses, e.g., two or more administrations of the "single unit dose". As used herein, a "single unit dose" is a dose of any therapeutic administered in one dose/at one time/single route/single point of contact, i.e., single administration event.

The desired dosage of the AAV particles of the present invention may be administered as a "pulse dose" or as a "continuous flow". As used herein, a "pulse dose" is a series of single unit doses of any therapeutic administered with a set frequency over a period of time. As used herein, a. "continuous flow" is a dose of therapeutic administered continuously for a period of time in a single route/single point of contact, i.e., continuous administration event. A total daily dose, an amount given or prescribed in 24 hour period, may be administered by any of these methods, or as a combination of these methods, or by any other methods suitable for a pharmaceutical administration.

In one embodiment, delivery of the AAV particles of the present invention to a subject provides neutralizing activity to a subject. The neutralizing activity can be for at least 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 20 months, 21 months, 22 months, 23 months, 2 years, 3 years, 4 years, 5 years, 6 years, 7 years, 8 years, 9 years, 10 years or more than 10 years.

In one embodiment delivery of the AAV particles of the present invention results in minimal serious adverse events (SAEs) as a result of the delivery of the AAV particles.

In one embodiment, delivery of AAV particles to cells of the central nervous system (e.g., parenchyma) may comprise a total dose between about $1 \times 10^6$ VG and about $1 \times 10^{16}$ VG. In some embodiments, delivery may comprise a total dose of about $1 \times 10^6$, $2 \times 10^6$, $3 \times 10^6$, $4 \times 10^6$, $5 \times 10^6$, $6 \times 10^6$, $7 \times 10^6$, $8 \times 10^6$, $9 \times 10^6$, $1 \times 10^7$, $2 \times 10^7$, $3 \times 10^7$, $4 \times 10^7$, $5 \times 10^7$, $6 \times 10^7$, $7 \times 10^7$, $8 \times 10^7$, $9 \times 10^7$, $1 \times 10^8$, $2 \times 10^8$, $3 \times 10^8$, $4 \times 10^8$, $5 \times 10^8$, $6 \times 10^8$, $7 \times 10^8$, $8 \times 10^8$, $9 \times 10^8$, $1 \times 10^9$, $2 \times 10^9$, $3 \times 10^9$, $4 \times 10^9$, $5 \times 10^9$, $6 \times 10^9$, $7 \times 10^9$, $8 \times 10^9$, $9 \times 10^9$, $1 \times 10^{10}$, $1.9 \times 10^{10}$, $2 \times 10^{10}$, $3 \times 10^{10}$, $3.37 \times 10^{10}$, $4 \times 10^{10}$, $5 \times 10^{10}$, $6 \times 10^{10}$, $7 \times 10^{10}$, $8 \times 10^{10}$, $9 \times 10^{10}$, $1 \times 10^{11}$, $2 \times 10^{11}$, $2.5 \times 10^{11}$, $3 \times 10^{11}$, $4 \times 10^{11}$, $5 \times 10^{11}$, $6 \times 10^{11}$, $7 \times 10^{11}$, $8 \times 10^{11}$, $9 \times 10^{11}$, $1 \times 10^{12}$, $2 \times 10^{12}$, $3 \times 10^{12}$, $4 \times 10^{12}$, $5 \times 10^{12}$, $6 \times 10^{12}$, $7 \times 10^{12}$, $8 \times 10^{12}$, $9 \times 10^{12}$, $1 \times 10^{13}$, $2 \times 10^{13}$, $3 \times 10^{13}$, $4 \times 10^{13}$, $5 \times 10^{13}$, $6 \times 10^{13}$, $7 \times 10^{13}$, $8 \times 10^{13}$, $9 \times 10^{13}$, $1 \times 10^{14}$, $2 \times 10^{14}$, $3 \times 10^{14}$, $4 \times 10^{14}$, $5 \times 10^{14}$, $6 \times 10^{14}$, $7 \times 10^{14}$, $8 \times 10^{14}$, $9 \times 10^{14}$, $1 \times 10^{15}$, $2 \times 10^{15}$, $3 \times 10^{15}$, $4 \times 10^{14}$, $5 \times 10^{14}$, $6 \times 10^{15}$, $7 \times 10^{15}$, $8 \times 10^{15}$, $9 \times 10^{15}$, or $1 \times 10^{16}$ VG. As a non-limiting example, the total dose is $1 \times 10^{13}$ VG. As another non-limiting example, the total dose is $2.1 \times 10^{12}$ VG.

In one embodiment, delivery of AAV particles to cells of the central nervous system (e.g., parenchyma) may comprise a composition concentration between about $1 \times 10^6$ VG/mL and about $1 \times 10^{16}$ VG mL. In some embodiments, delivery may comprise a composition concentration of about $1 \times 10^6$, $2 \times 10^6$, $3 \times 10^6$, $4 \times 10^6$, $5 \times 10^6$, $6 \times 10^6$, $7 \times 10^6$, $8 \times 10^6$, $9 \times 10^6$, $1 \times 10^7$, $2 \times 10^7$, $3 \times 10^7$, $4 \times 10^7$, $5 \times 10^7$, $6 \times 10^7$, $7 \times 10^7$, $8 \times 10^7$, $9 \times 10^7$, $1 \times 10^8$, $2 \times 10^8$, $3 \times 10^8$, $4 \times 10^8$, $5 \times 10^8$, $6 \times 10^8$, $7 \times 10^8$, $8 \times 10^8$, $9 \times 10^8$, $1 \times 10^9$, $2 \times 10^9$, $3 \times 10^9$, $4 \times 10^9$, $5 \times 10^9$, $6 \times 10^9$, $7 \times 10^9$, $8 \times 10^9$, $9 \times 10^9$, $1 \times 10^{10}$, $2 \times 10^{10}$, $3 \times 10^{10}$, $4 \times 10^{10}$, $5 \times 10^{10}$, $6 \times 10^{10}$, $7 \times 10^{10}$, $8 \times 10^{10}$, $9 \times 10^{10}$, $1 \times 10^{11}$, $2 \times 10^{11}$, $3 \times 10^{11}$, $4 \times 10^{11}$, $5 \times 10^{11}$, $6 \times 10^{11}$, $7 \times 10^{11}$, $8 \times 10^{11}$, $9 \times 10^{11}$, $1 \times 10^{12}$, $2 \times 10^{12}$, $3 \times 10^{12}$, $4 \times 10^{12}$, $5 \times 10^{12}$, $6 \times 10^{12}$, $7 \times 10^{12}$, $8 \times 10^{12}$, $9 \times 10^{12}$, $1 \times 10^{13}$, $2 \times 10^{13}$, $3 \times 10^{13}$, $4 \times 10^{13}$, $5 \times 10^{13}$, $6 \times 10^{13}$, $7 \times 10^{13}$, $8 \times 10^{13}$, $9 \times 10^{13}$, $1 \times 10^{14}$, $2 \times 10^{14}$, $3 \times 10^{14}$, $4 \times 10^{14}$, $5 \times 10^{14}$, $6 \times 10^{14}$, $7 \times 10^{14}$, $8 \times 10^{14}$, $9 \times 10^{14}$, $1 \times 10^{15}$, $2 \times 10^{15}$, $3 \times 10^{15}$, $4 \times 10^{15}$, $5 \times 10^{15}$, $6 \times 10^{15}$, $7 \times 10^{15}$, $8 \times 10^{15}$, $9 \times 10^{15}$, or $1 \times 10^{16}$ G/mL. In one embodiment, the delivery comprises a composition concentration of $1 \times 10^{13}$ VG/mL. In one embodiment, the delivery comprises a composition concentration of $2.1 \times 10^{12}$ VG/mL.

Combinations

The AAV particles may be used in combination with one or more other therapeutic, prophylactic, research or diagnostic agents. By "in combination with," it is not intended to imply that the agents must be administered at the same time and/or formulated for delivery together, although these methods of delivery are within the scope of the present invention. Compositions can be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, research, or diagnostic compositions in combination with agents that may improve their bioavailability, reduce and/or modify their metabolism, inhibit their excretion, and/or modify their distribution within the body.

Measurement of Expression

Expression of payloads from viral genomes may be determined using various methods known in the art such as, but not limited to immunochemistry (IHC), in situ hybridization (ISH), enzyme-linked immunosorbent assay (ELISA), affinity ELISA, ELISPOT, flow cytometry, immunocytology, surface plasmon resonance analysis, kinetic exclusion assay, liquid chromatography-mass spectrometry (LCMS), high-performance liquid chromatography (HPLC), BCA assay, immunoelectrophoresis, Western blot, SDS-PAGE, protein immunoprecipitation, and/or PCR.

Bioavailability

The AAV particles, when formulated into a composition with a delivery agent as described herein, can exhibit an increase in bioavailability as compared to a composition lacking a delivery agent as described herein. As used herein, the term "bioavailability" refers to the systemic availability of a given amount of AAV particle or expressed payload administered to a mammal. Bioavailability can be assessed by measuring the area under the curve (AUC) or the maximum serum or plasma concentration ($C_{max}$) of the composition following. AUC is a determination of the area under the curve plotting the serum or plasma concentration of a compound (e.g., AAV particles or expressed payloads) along the ordinate (Y-axis) against time along the abscissa (X-axis). Generally, the AUC for a particular compound can be calculated using methods known to those of ordinary skill in the art and as described in G. S. Banker, Modern Pharmaceutics, Drugs and the Pharmaceutical Sciences, v. 72, Marcel Dekker, New York, Inc., 1996, the contents of which are herein incorporated by reference in its entirety.

The $C_{max}$ value is the maximum concentration of the AAV particle or expressed payload achieved in the serum or plasma of a mammal following administration of the AAV particle to the mammal. The $C_{max}$ value of can be measured using methods known to those of ordinary skill in the art. The phrases "increasing bioavailability" or "improving the pharmacokinetics," as used herein mean that the systemic availability of a first AAV particle or expressed payload, measured as AUC, $C_{max}$, or $C_{min}$ in a mammal is greater, when co-administered with a delivery agent as described herein, than when such co-administration does not take place. In some embodiments, the bioavailability can increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%.

Therapeutic Window

As used herein "therapeutic window" refers to the range of plasma concentrations, or the range of levels of therapeutically active substance at the site of action, with a high probability of eliciting a therapeutic effect. In some embodiments, the therapeutic window of the AAV particle as described herein can increase by at least about 2%, at least about 5%, at least about 10%, at least about 15%, at least about 20%, at least about 25%, at least about 30%, at least about 35%, at least about 40%, at least about 15%, at least about 50%, at least about 55%, at least about 60%, at least about 65%, at least about 70%, at least about 75%, at least about 80%, at least about 85%, at least about 90%, at least about 95%, or about 100%.

Volume of Distribution

As used herein, the term "volume of distribution" refers to the fluid volume that would be required to contain the total amount of the drug in the body at the same concentration as in the blood or plasma: $V_{dist}$ equals the amount of drug in the body/concentration of drug in blood or plasma. For example, for a 10 mg dose and a plasma concentration of 10 mg/L, the volume of distribution would be 1 liter. The volume of distribution reflects the extent to which the drug is present in the extravascular tissue. A large volume of distribution reflects the tendency of a compound to bind to the tissue components compared with plasma protein binding. In a clinical setting, $V_{dist}$ can be used to determine a loading dose to achieve a steady state concentration. In some embodiments, the volume of distribution of the AAV particles as described herein can decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Biological Effect

In one embodiment, the biological effect of the AAV particles delivered to the animals may be categorized by analyzing the payload expression in the animals. The payload expression may be determined from analyzing a biological sample collected from a mammal administered the AAV particles of the present invention. For example, a protein expression of 50-200 pg/ml for the protein encoded by the AAV particles delivered to the mammal may be seen as a therapeutically effective amount of protein in the mammal.

IV. Methods and Uses of the Compositions of the Invention

The present disclosure provides a method for treating a disease, disorder and/or condition in a mammalian subject, including a human subject, comprising administering to the subject any of the AAV particles described herein or administering to the subject any of the described compositions, including pharmaceutical compositions, described herein.

In one embodiment, the AAV particles of the present invention are administered to a subject prophylactically.

In one embodiment, the AAV particles of the present invention are administered to a subject having at least one of the diseases described herein.

In one embodiment, the AAV particles of the present invention are administered to a subject to treat a disease or disorder described herein. The subject may have the disease or disorder or may be at-risk to developing the disease or disorder.

In one embodiment, the AAV particles of the present invention are part of an active immunization strategy to protect against diseases and disorders. In an active immunization strategy, a vaccine or AAV particles are administered to a subject to prevent an infectious disease by activating the subject's production of antibodies that can fight off invading bacteria or viruses.

In one embodiment, the AAV particles of the present invention are part of a passive immunization strategy. In a passive immunization strategy, antibodies against a particular infectious agent are given directly to the subject.

Diseases and Toxins

Various infectious diseases may be treated with pharmaceutical compositions, AAV particles, of the present invention. As used herein, the term "infectious disease" refers to any disorders caused by organisms such as bacteria, viruses, fungi or parasites. As a non-limiting example, the infectious disease may be Acute bacterial rhinosinusitis, 14-day measles, Acne, Acrodermatitis chronica atrophicans (ACA)-(late skin manifestation of latent Lyme disease), Acute hemorrhagic conjunctivitis, Acute hemorrhagic cystitis, Acute rhinosinusitis, Adult T-cell Leukemia-Lymphoma (ATLL), African Sleeping Sickness, AIDS (Acquired Immunodeficiency Syndrome), Alveolar hydatid, Amebiasis, Amebic meningoencephalitis, Anaplasmosis, Anthrax, Arboviral or parainfectious, Ascariasis (Roundworm infections), Aseptic meningitis, Athlete's foot (Tinea pedis), Australian tick typhus, Avian influenza, Babesiosis, Bacillary angiomatosis, Bacterial meningitis, Bacterial vaginosis, Balanitis, Balantidiasis, Bang's disease, Barinah Forest virus infection, Bartonellosis (Verruga peruana; Carrion's disease; Oroya fever), Bat Lyssavirus Infection, Bay sore (Chiclero's ulcer), Bitylisaicaris infection (Racoon roundworm infection), Beaver fever, Beef tapeworm, Bejel (endemic syphilis), Biphasic meningoencephalitis, Black Bane, Black death, Black piedra, Blackwater Fever, Blastomycosis, Blennorrhea of the newborn, Blepharitis, Boils, Bornholm disease (pleurodynia), Borrelia miyamotoi Disease, Botulism, Boutonneuse fever, Brazilian purpuric fever, Break Bone fever, Brill, Bronchiolins, Bronchitis, Brucellosis (Bang's disease), Bubonic plague, Bullous impetigo, Burkholderia (Glanders), Burkholderia pseudomallei (Melioidosis), Buruli Ulcers (also Mycoburuli ulcers), Busse, Busse-Buschke disease (Cryptococcosis), California group encephalitis, Campylobacteriosis, Candidiasis, Canefield fever (Canicola fever; 7-day fever; Wed's disease; leptospirosis; cariefield fever), Canicola fever, Capillariasis, Carate, Carbapenem-resistant Enterobacteriaceae (CRE), Carbuncle, Carrion's disease, Cat Scratch fever, Cave disease, Central Asian hemorrhagic fever, Central European tick, Cervical cancer, Chagas disease, Chancroid (Soft chancre), Chicago disease, Chickenpox (Varicella), Chiclero's ulcer, Chikungunya fever, Chlamydial infection, Cholera, Chromoblastomycosis, Ciguatera, Clap, Clonorchiasis (Liver fluke infection), Clostridium Difficile Infection, Clostridium Perfringens (Epsilon Toxin), Coccidioidomycosis fungal infection (Valley fever; desert rheumatism), Coenurosis, Colorado tick fever, Condyloma accuminata, Condyloma accuminata Warts), Condyloma lata, Congo fever, Congo hemorrhagic fever virus, Conjunctivitis cowpox, Crabs, Crimean, Croup, Cryptococcosis, Cryptosporidiosis (Crypto), Cutaneous Larval Migrans, Cyclosporiasis, Cystic hydatid, Cysticercosis, Cystitis, Czechoslovak tick, D68 (EV-D68), Dacryocytitis, Dandy fever, Darling's Disease, Deer fly fever, Dengue fever (1, 2, 3 and 4), Desert rheumatism, Devil's grip, Diphasic milk fever, Diphtheria, Disseminated intravascular Coagulation, Dog tapeworm, Donovanosis, Donovanosis (Granuloma inguinale), Dracontiasis, Dracunculosis, Duke's disease, Dum Dum Disease, Durand-Nicholas-Favre disease, Dwarf tapeworm, E. Coli infection (E. Coli), Eastern equine encephalitis, Ebola Hemorrhagic Fever (Ebola virus disease EVD), Ectothrix, Ehrlichiosis (Sennetsu fever), Encephalitis, Endemic Relapsing fever, Endemic syphilis, Endophthalmitis, Endothrix, Enterobiasis (Pinworm infection), Enterotoxin-B Poisoning (Staph Food Poisoning), Enterovirus Infection, Epidemic Keratoconjunctivitis, Epidemic Relapsing fever, Epidemic typhus, Epiglottitis, Erysipelis, Erysipeloid (Erysipelothricosis), Erythema chronicum migrans, Erythema infectiosum, Erythema marginatum, Erythema multiforme, Erythema nodosum, Erythema nodosum leprosum, Erythrasma, Espundia, Eumycotic mycetoma, European blastomycosis, Exanthem subitum (Sixth disease), Eyeworm, Far Eastern tick, Fascioliasis, Fievre boutonneuse (Tick typhus), Fifth Disease (erythema infectiosum), Filatow-Dukes' Disease (Scalded Skin Syndrome; Ritter's Disease), Fish tapeworm, Fitz-Hugh-Curtis syndrome-Perihepatitis, Flinders Island Spotted Fever, Flu (Influenza), Folliculitis, Four Corners Disease, Four Corners Disease (Human Pulmonary Syndrome (HPS)), Frambesia, Francis disease, Furunculosis, Gas gangrene, Gastroenteritis, Genital Herpes, Genital Warts, German measles, Gerstmann-Straussler-Scheinker (GSS), Giardiasis, Gilchrist's disease, Gingivitis, Gingivostomatitis, Glanders, Glandular fever (infectious mononucleosis), Gnathostomiasis, Gonococcal infection (Gonorrhea), Gonorrhea, Granuloma inguinale (Donovanosis), Guinea Worm, Haemophilus Influenza disease, Hamburger disease, Hansen's disease—leprosy, Hantaan disease, Hantaan-Korean hemorrhagic fever, Hantavirus Pulmonary Syndrome, Hantavirus Pulmonary Syndrome (HPS), Hard chancre, Hard measles, Haverhill fever—Rat bite fever, Head and Body Lice, Heartland fever, Helicobacterosis, Hemolytic Uremic Syndrome (HUS), Hepatitis A, Hepatitis B, Hepatitis C, Hepatitis D, Hepatitis B, Hemangina, Herpes-genital, Herpes labialis, Herpes-neonatal, Hidradenitis, Histoplasmosis, Histoplasmosis infection (Histoplasmosis), His-Werner disease, HIV infection, Hookworm infections, Hordeola, Hordeola (Stye), HTLV, HTLV-associated myelopathy (HAM), Human granulocytic ehrlichiosis, Human monocytic ehrlichiosis, Human Papilloinavirus (HPV), Human Pulmonary Syndrome, Hydatid cyst, Hydrophobia, Impetigo, Including congenital (German Measles), Inclusion conjunctivitis, Inclusion conjunctivitis-Swimming Pool conjunctivitis-Pannus, Infantile diarrhea, Infectious Mononucleosis, Infectious myocarditis, infectious pericarditis, Influenza, Isosporiasis, Israeli spotted fever, Japanese Encephalitis, Jock itch, Jorge Lobo disease lobomycosis, Jungle yellow fever, Junin Argentinian hemorrhagic fever, Kala Azar, Kaposi's sarcoma, Keloidal blastomycosis, Keratoconjunctivitis Kuru, Kyasanur forest disease, LaCrosse encephalitis, Lassa hemorrhagic fever, Legionellosis (Legionnaires Disease), Legionnaire's pneumonia, Lemierre's Syndrome (Postanginal septicemia), Lemming fever, Leprosy, Leptospirosis (Nanukayami fever; Weil's disease), Listeriosis (Listeria), Liver fluke infection, Lobo's mycosis, Lockjaw, Loiasis, Louping III, Ludwig's angina, Lung fluke infection, Lung fluke infection (Paragonimiasis), Lyme disease, Lymphogranuloma venereum infection (LGV), Machupo Bolivian hemorrhagic fever, Madura foot, Mal del pinto, Malaria, Malignant pustule, Malta fever, Marburg hemorrhagic fever, Masters disease, Maternal Sepsis (Puerperal fever), Measles, Mediterranean spotted fever, Melioidosis (Whitmore's disease), Meningitis, Meningococcal Disease, MERS, Milker's nodule, Molluscum contagiosum, Moniliasis, monkeypox, Mononucleosis, Mononucleosis-like syndrome, Montezuma's Revenge, Morbilli MRSA (methicillin-resistant *Staphylococcus aureus*) infection, Mucormycosis-Zygomycosis, Multiple Organ Dysfunction Syndrome or MODS, Multiple-system atrophy (MSA), Mumps, Murine typhus, Murray Valley Encephalitis (MVE), Mycoburuh ulcers, Mycoburuli ulcers-Buruli ulcers, Mycotic vulvovaginitis, Myositis, Nanukayami fever, Necrotizing fasciitis, Necrotizing fasciitis-Type 1, Necrotizing fasciitis-Type 2, Negishi, New world sported fever, Nocardiosis, Nongonococcal urethritis, Non-Polio (Non-Polio Enterovirus), Norovirus infection, North American blastornycosis, North Asian tick typhus, Norwalk virus infection, Norwegian itch, O'Hara disease, Omsk hemorrhagic fever, Onchoceriasis, Onychomycosis, Opisthorchiasis, Opthalmia neonatorium, Oral hairy leukoplakia, Orf, Oriental Sore, Oriental Spotted Fever, Ornithosis (Parrot fever; Psittacosis), Oroya fever, Otitis extema, Otitis media, Pannus, Parttcoccidioidomycosis, Paragonimiasis, Paralytic Shellfish Poisoning (Paralytic Shellfish Poisoning), Paronychia (Whitlow), Parotitis, PCP pneumonia, Pediculosis, Peliosis hepatica, Pelvic Inflammatory Disease, Pertussis (also called Whooping cough), Phaeohyphomycosis, Pharyngoconjunctival fever, Piedra (White Piedra), Piedra (Black Piedra), Pigbel, Pink eye conjunctivitis, Pinta, Pinworm infection, Pitted Keratolysis, Pityriasis versicolor (Tinea versicolor), Plague; Bubonic, Pleurodynia, Pneumococcal Disease, Pneumocystosis, Pneumonia, Pneumonic (Plague), Polio or Poliomyelitis, Polycystic hydatid, Pontiac fever, Pork tapeworm, Posada-Wemicke disease, Postanginal septicemia, Powassan, Progressive multifocal leukencephalopathy, Progressive Rubella Panencephalitis, Prostatitis, Pseudomembranous colitis, Psittacosis, Puerperal fever, Pustular Rash diseases (Small pox), Pyelonephritis, Pyleplalebitis, Q-Fever, Quinsy, Quintana fever (5-day fever), Rabbit fever, Rabies, Racoon roundworm infection, Rat bite fever, Rat tapeworm, Reiter Syndrome, Relapsing fever, Respiratory syncytial virus (RSV) infection, Rheumatic fever, Rhodotorulosis, Ricin Poisoning, Rickettsialpox, Rickettsiosis Rift Valley Fever, Ringworm, Ritter's Disease, River Blindness, Rocky Mountain spotted fever, Rose Handler's disease (Sporotrichosis), Rose rash of infants, Roseola, Ross River fever, Rotavirus infection, Roundworm infections, Rubella, Rubeola, Russian spring, Salmonellosis gastroenteritis, San Joaquin Valley fever, Sao Paulo Encephalitis, Sao Paulo fever, SARS, Scabies Infestation (Scabies) (Norwegian itch), Scalded Skin Syndrome, Scarlet fever (Scarlatina), Schistosomiasis, Scombroid, Scrub typhus, Sennetsu fever, Sepsis (Septic shock), Severe Acute Respiratory Syndrome, Severe Acute Respiratory Syndrome (SARS), Shiga, Toxigenic Escherichia cob (STECNTEC), Shigellosis gastroenteritis (Shigella), Shinbone fever, Shingles, Shipping fever, Siberian tick typhus, Sinusitis, Sixth disease, Slapped cheek disease Sleeping sickness, Smallpox (Vanilla), Snail Fever, Soft chancre, Southern tick associated rash illness, Sparganosis, Spelunker's disease, Sporadic typhus, Sporotrichosis, Spotted fever, Spring, St. Louis encephalitis, Staphylococcal Food Poisoning, Staphylococcal Infection, Strep throat, Streptococcal Disease, Streptococcal Toxic-Shock Syndrome, Strongyloiciasis, Stye, Subacute Sclerosing Panencephalitis Subacute Sclerosing Panencephalitis (SSPE), Sudden Acute Respiratory Syndrome, Sudden Rash, Swimmer's ear, Swimmer's Itch, Swimming Pool conjunctivitis, Sylvatic yellow fever, Syphilis, Systemic Inflammatory Response Syndrome (SIRS), Tabes dorsalis (tertiary syphilis), Taeniasis, Taiga encephalitis, Tanner's disease, Tapeworm infections, Temporal lobe encephalitis, Temporal lobe encephalitis, tetani (Lock Jaw), Tetanus infection, Threadworm infections, Thrush, Tick, Tick typhus, Tinea barbae, Tinea capitis, Tinea corporis, Tinea cruris, Tinea manuum, Tinea nigra, Tinea pedis, Tinea unguium, Tinea eersicolor, Torulopsosis, Torulosis, Toxic Shock Syndrome, Toxoplasmosis, transmissible spongioform (CJD), Traveler's diarrhea, Trench fever 5, Trichinellosis, Trichomoniasis, Trichomycosis axillaris, Trichuriasis, Tropical Spastic Paraparesis (TSP), Trypanosomiasis, Tuberculosis (TB), Tuberculousis, Tularemia, Typhoid Fever, Typhus fever, Ulcus niolle, lindulant fever, urban yellow fever, Urethritis, Vaginitis, Vaginosis, Vancomycin Intermediate (VISA), Vancomycin Resistant (VISA), Varicella, Venezuelan Equine encephalitis, Verruga peruana, Vibrio cholerae (Cholera), Vibriosis (Vibrio), Vincent's disease or Trench mouth, Viral conjunctivitis, Viral Meningitis, Viral meningoencephalitis, Viral rash, Visceral Larval Migrans, Vomito negro, Vulvovaginitis, Warts, Waterhouse, Well's disease, West Nile Fever, Western equine encephalitis, Whipple's disease, Whipworm infection, White Piedra, Whitlow, Whitmore's disease, Winter diarrhea, Wolhynia fever, Wool sorters' disease, Yaws, Yellow Fever, Yersinosis, Yersinosis (Yersinia), Zahorsky's disease, Zika virus disease, Zoster, Zygomycosis, John Cunningham Virus (XV), Human immunodeficiency virus (HIV), Influenza virus, Hepatitis B, Hepatitis C, Hepatitis D, Respiratory-syncytial virus (RSV), Herpes simplex virus 1 and 2, Human Cytomegalovirus, Epstein-Barr virus, Varicella zoster virus, Coronaviruses Poxxiruses, Enterovirus 71, Rubella, virus, Human papilloma virus, *Streptococcus pneumoniae, Streptococcus viridans, Staphylococcus aureus* (*S. aureus*), Methicillin-resistant *Staphylococcus aureus* (MRSA), Vancomycin-intermediate *Staphylococcus aureas* (VISA), Vancomycin-resistant *Staphylococcus aureus* (VRSA), *Staphylococcns epidermidis* (*S. epidermidis*), *Clostridium Tetani, Bordetella pertussis, Bordetella paratussis, Mycobacterium, Francisella Tularensis, Toxoplasma gondii*, Candida (*C. albicans, C. glabrata, C. parapsdosis, C. tropicalts, C. krusei* and *C. lusitaniae*) and/or any other infectious diseases, disorders or syndromes.

Various toxins may be treated with the pharmaceutical compositions, AAV particles, of the present invention. Non-limited examples of toxins include Ricin, Bacillus anthracis, Shiga toxin and Shiga-like toxin, Botulinum toxins.

Various tropical diseases may be treated with pharmaceutical compositions, AAV particles, of the present in Non-limited examples of tropical diseases include Chikungunya fever, Dengue fever, Chagas disease, Rabies, Malaria, Ebola virus, Marburg virus, West Nile Virus, Yellow Fever, Japanese encephalitis virus, St. Louis encephalitis virus.

Various foodborne illnesses and gastroenteritis may be treated with pharmaceutical compositions, AAV particles, of the present invention. Non-limited examples of foodborne illnesses and gastroenteritis include Rotavirus, Norwalk virus (Norovirus), Canipylobacter jejuni, Clostridium difficile, Entamoeba histolytica, Helicobacter pyroli, Enterotoxin B of *Staphylococcus aureus*, Hepatitis A virus (HAV), Hepatitis F, *Listeria monocytogenes, Salmonella, Clostridium perfringens,* and *Salmonella.*

Various infectious agents may be treated with pharmaceutical compositions, AAV particles, of the present invention. Non-limited examples of infectious agents include adenoviruses, *Anaplasma phagocytophillium, Ascaris lumbricoides, Bacillus anthracis, Bacillus cereus, Bacteriodes* sp, Barmah Forest virus, *Bartonella bacilliformis, Bartonella henselae, Bartonella quintana*, beta-toxin of *Clostridium perfringens, Bordetella pertussis, Bordetella parapertussis, Borrelia burgdorferi, Borrelia miyamotoi, Borrelia recurrentis, Borrelia* sp., *Botulinum* toxin, *Brucella* sp., *Burkholderia pseudomallei*, California encephalitis virus, *Campylobacter, Candida albicans*, chikungunya virus, *Chlamydia psittaci, Chlamydia trachomatis, Clonorchis sinensis, Clostridium difficile* bacteria, *Clostridium tetani*, Colorado tick fever virus, *Corynebacterium diptheriae, Corynebacterium miutissimum, Coxiello burnetii*, coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis, Ehrlichia equi., Ehrlichia* sp., *Entamoeba histolytica, Enterobacter* sp., *Entercoccus feacalis*, Enterovirus 71, Epstein-Barr virus (EBV), *Erysipelothrix rhusiopathiae, Escherichia coli,* Flavivirus, *Fusobacterium necrophorum, Gardnerella vaginalis*, Group B *streptococcus*, Haemophoilus aegyptius, Haemophilus ducreyl, Haemophilus influenzae, hantavirus, *Helicobacter pylori*, Hepatitis A, Hepatitis B, Hepatitis C, Hepatitis D, Hepatitis E, herpes simplex virus 1 and 2 human herpes virus 6, human herpes Virus 8, human immunodeficiency virus 1 and 2, human T-cell leukemia viruses II and II, influenza viruses (A, B, C), Jamestown Canyon virus, Japanese encephalitis antigenic, Japanese encephalitis virus, John Cunningham virus, Juninvirus, Kaposi's Sarcoma-associated Herpes Virus (KSHV), *Klebsiella granulomatis, Klebsiella* sp., Kyasanur Forest Disease virus, La Crosse virus, Lassavirus, *Legionella pneumophila, Leptospira interrogans, Listeria monocytogenes*, lymphocytic choriomeningitis virus, lyssavirus, Machupovirus, Marburg virus, measles virus, MERS coronavirus (MERS-CoV), *Micrococcus sedentarius, Mobiluncus* sp. *Molluscipoxvirus, Moraxella catarrhalis, Morbilli-Rubeola* virus, Mumpsvirus, *Mycobacterium leprae, Mycobacterium tuberculosis, Mycobacterium ulcerans, Mycoplasma genitalium, Mycoplasma* sp, Nairovirus, *Neisseria gonorrhoeae, Neisseria meningitidis, Nocardia*, Norwalk virus, norovirus, Omsk hemorrhagic fever virus, papilloma virus, parainfluenza viruses 1-3, parapoxvirus, parvovirus B19, *Peptostreptococccus* sp., *Plasmodium* sp., polioviruses types I, H, and ITT, *Proteus* sp., *Pseudomonas aeraginosa, Pseudomonas pseudomallei, Pseudomonas* sp., rabies virus, respiratory syncytial virus, ricin toxin, *Rickettsia australis, Rickettsia conori, Rickettsia honei, Rickettsia prawazekii*, Ross River Virus, rotavirus, rubellavirus, Saint Louis encephalitis, *Salmonella Typhi, Sarcoptes scabiei*, SARS-associated coronavirus (SARS-CoV), *Serratia* sp., Shiga toxin and Shiga-like toxin, *Shigella* sp., Sin Nombre Virus, Snowshoe hare virus, *Staphylococcus aureus, Staphylococcus epidermidis, Streptobacillus moniliformis, Streptoccoccus pneumoniae, Streptococcus agalactiae, Streptococcus agalactiae, Streptococcus* group A-H, *Streptococcus pneumoniae, Streptococcus pyogenes, Treponema pailidum* subsp. *Pallidum, Treponema pallidum* var. *carateum, Treponema pallium* var. *endemicum, Tropheryma whippelii, Ureaplasma urealyticum*, Varicella-Zoster virus, variola virus, *Vibrio Cholerae*, West Nile virus, yellow fever virus *Yersinia enterocolitico, Yersinia pestis*, and Zika virus.

Various rare diseases may be treated with pharmaceutical compositions. AAV particles, of the present invention. As used herein, the term "rare disease" refers to any disease that affects a small percentage of the population. As a non-limiting example, the rare disease may be Acrocephalosyndactylia, Acrodermatitis, Addison Disease, Adie Syndrome, Alagille Syndrome, Amylose, Amyotrophic Lateral Sclerosis, Angelman Syndrome, Angiobimphoid Hyperplasia with Eosinophilia, Arnold-Chiari Malformation, Arthritis, Juvenile Rheumatoid, Asperger Syndrome, Bardet-Biedl Syndrome, Barrett Esophagus, Beckwith-Wiedemann Syndrome, Behcet Syndrome, Bloom Syndrome, Bowen's Disease, Brachial Plexus Neuropathies, Brown-Sequard Syndrome, Budd-Chian Syndrome, Burkitt Lymphoma, Carcinoma 256, Walker, Carob Disease, Charcot-Marie-Tooth Disease, Chediak-Higashi Syndrome, Chiari-Frommel Syndrome, Chondrodysplasia Punctata, Colonic Pseudo-Obstruction, Colorectal Neoplasms, Hereditary Noripolyposis, Craniofacial Dysostosis, Creutzfeldt-Jakob Syndrome, Crohn Disease, Cushing Syndrome, Cystic Fibrosis, Dandy-Walker Syndrome, De Lange Syndrome, Dementia, Vaschlar, Dermatitis Herpetiformis, DiGeorge Syndrome, Diffuse Cerebral Sclerosis of Schilder, Duane Retraction Syndrome, Dupuytren Contracture, Ebstein Anomaly, Eisenmenger Complex, Ellis-Van Creveld Syndrome, Encephalitis, Enchondromatosis, Epidermal Necrolysis, Toxic, Facial Hemiatrophy, Factor XII Deficiency, Fanconi Anemia, Felty's Syndrome, Fibrous Dysplasia, Polyostotic, Fox-Fordyce Disease, Friedreich Ataxia, Fusobacterium, Gardner Syndrome, Gaucher Disease, Gerstmann Syndrome, Giant Lymph Node Hyperplasia, Glycogen Storage Disease Type I, Glycogen Storage Disease Type II, Glycogen Storage Disease Type IV, Glycogen Storage Disease Type V, Glycogen. Storage Disease Type VII, Goldenhar Syndrome, Guillain-Barre Syndrome, Hallermann's Syndrome, Hamartoma Syndrome, Multiple, Hartnup Disease, Hepatolenticular Degeneration, Hepatolenticular Degeneration, Hereditary Sensory and Motor Neuropathy, Hirschsprung Disease. Histiocytic Necrotizing Lymphadenitis, Histiocytosis, Langerhans-Cell, Hodgkin Disease, Homer Syndrome, Huntington Disease, Hyperaldosteronism, Hyperhidrosis, Hyperostosis, Diffuse Idiopathic Skeletal, Hypopituitarism, Inappropriate ADH Syndrome, Intestinal Polyps, Isaacs Syndrome, Kartagener Syndrome, Keams-Sayre Syndrome, Klippel-Feil Syndrome, Klippel-Trenaunay-Weber Syndrome, Kluver-Bucy Syndrome, Korsakoff Syndrome, Lafora Disease, Lambert-Eaton Myasthenic Syndrome, Landau-Kleffner Syndrome, Langer-Giedion Syndrome, Leigh Disease, Lesch-Nyhan Syndrome, Leukodystrophy, Globoid Cell, Li-Fraumeni Syndrome, Long QT Syndrome, Machado-Joseph Disease, Mallory-Weiss Syndrome, Marek Disease, Marfan Syndrome, Meckel Diverticulum, Meige Syndrome, Melkersson-Rosenthal Syndrome, Meniere Disease, Mikulicz' Disease, Miller Fisher Syndrome, Mobius Syndrome, Moyamoya Disease, Mucocutaneous Lymph Node Syndrome, Mucopolysaccharidosis I, Mucopolysaccharidosis II, Mucopolysaccharidosis Mucopoh saccharidosis IV, Mucopolysaccharidosis I, Multiple Endocrine Neoplasia Type 1, Munchausen Syndrome by Proxy, Muscular Atrophy, Spinal, Narcolepsy, Neuroaxonal Dystrophies, Neuromyelitis Optica, Neuronal Ceroid-Lipofuscinoses, Niemann-Pick Diseases, Noonan Syndrome, Optic Atrophies, Hereditary, Osteitis Deformans, Osteochondritis, Osteochondrodysplasias, Osteolysis, Essential, Paget Disease Extramammary, Paget's Disease, Mammary, Panniculitis, Nodular Nonsuppurative, Papillon-Lefevre Disease, Paralysis, Pelizaeus-Merzhacher Disease, Pemphigus, Benign Familial, Penile induration, Pericarditis, Constrictive, Peroxisomal Disorders, Peutz-Jeghers Syndrome, Pick Disease of the Brain, Pierre Robin Syndrome, Pigmentation Disorders, Pityriasis Lichenoides Polycystic Ovary Syndrome, Polyendocrinopathies, Autoimmune, Prader-Willi Syndrome, Pupil Disorders, Rett Syndrome, Reye Syndrome, Rubinstein-Taybi Syndrome, Sandhoff Disease, Sarcoma, Ewing's, Schnitzler Syndrome, Sjogren's Syndrome, Sjogren-Larsson Syndrome, Smith-Lemli-Opitz Syndrome, Spinal Muscular Atrophies of Childhood, Sturge-Weber Syndrome, Sweating, Gustatory, Takayasu Arteritis, Tangier Disease, Tay-Sachs Disease, Thromboangiitis Obliterans, Thyroiditis, Autoimmune, Tietze's Syndrome, Togaviridae Infections, Tolosa-Hunt Syndrome, Tourette Syndrome, Uveomeningoencephalitic Syndrome, Waardenburg's Syndrome, Wegener Granulomatosis, Wed Disease, Werner Syndrome, Williams Syridrome, Wilms Tumor, Wolff-Parkinson-White Syndrome, Wolfram Syndrome, Wolman Disease, Zellweger Syndrome, Zollinger-Ellison Syndrome, and von Willebrand Diseases.

Various autoimmune diseases and autoimmune-related diseases may be treated with pharmaceutical compositions, AAV particles, of the present invention. As used herein, the term "autoimmune disease" refers to a disease in which the body produces antibodies that attack its own tissues. As a non-limiting example, the autoimmune disease may be Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune oophoritis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal osteomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackie myocarditis, CREST disease, Essential mixed cryoglobulinemia, Demyelinating neuropathies, Dermatitis herpetiformis, Dermatomyositis, Devic's disease (neuromyelitis optica), Discoid lupus, Dressier's syndrome, Endometriosis, Eosinophilic esophagitis, Eosinophilic fasciitis, Erythema nodosum, Experimental allergic encephalomyelitis, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis (GPA) (formerly called Wegener's Granulomatosis), Graves' disease, Guillain-Barre syndrome, Hashimoto's encephalitis, Hashimoto's thyroiditis, Hemolytic anemia, Henoch-Schonlein purpura, Herpes gestationis, Hypogannnaglobulinemia, Idiopathic thrombocytopenic purpura (ITP), IgA nephropathy, IgG4-related sclerosing disease, Immunoregulatory lipoproteins, Inclusion body myosins, interstitial cystitis, Juvenile arthritis, Juvenile diabetes (Type 1 diabetes), Juvenile myositis, Kawasaki syndrome, Lambert-Eaton syndrome, Leukocytoclastic vasculitis, Lichen planus, Lichen sclerosus, Ligneous conjundivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple sclerosis, Myasthenia gravis, Myosins, Narcolepsy, Neuromyelitis optica (Devic's), Neutropenia, Ocular cicatricial pemphigoid, Optic neuritis, Palindromic rheumatism, PANDAS (Pediatric Autoimmune Neuropsychiatric Disorders Associated with Streptococcus), Paraneoplastic cerebellar degeneration, Paroxysmal nocturnal hemoglobinuria (PNH), Parry Romberg Syndr Parsonnage-Turner syndrome, Pars planitis (peripheral uveitis), Pemphigus, Peripheral neuropathy, Perivenous encephalomyelitis, Pernicious anemia, POEMS syndrome, Polyarteritis nodosa, Type I, II, & III autoimmune poly glandular syndromes, Polymyalgia rheumatica, Polymyositis, Postmyocardial infarction syndrome, Postpericardiotomy syndrome, Progesterone dermatitis, Primary biliary cirrhosis, Primary sclerosing, cholangitis, Psoriasis, Psoriatic arthritis, Idiopathic pulmonary fibrosis, Pyoderma gangrenosum, Pure red cell aplasia, Raynauds phenomenon, Reactive Arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocytopenic; purpura (TTP), Tolosa-Hunt syndrome, Transverse myelitis, Ulcerative colitis, Undifferentiated connective tissue disease (UCTD), Uveitis, Vasculitis, Vesiculobullous dermatosis, Vitiligo, and Wegener's granulomatosis (now termed Granulomatosis with Polyangiitis (GPA).

Various kidney diseases may be treated with pharmaceutical compositions, AAV particles, of the present invention. As a non-limiting, example, the kidney disease Abderhalden-Kaufmann-Lignac syndrome (Nephropathic Cystinosis), Abdominal Compartment Syndrome, Acute Kidney Failure/Acute Kidney Injury, Acute Lobar Nephronia, Acute Phosphate Nephropathy, Acute Tubular Necrosis, Adenine Phosphoribosyltransferase Deficiency, Adenovirus Nephritis, Alport Syndrome, Amyloidosis, ANCA Vasculitis Related to Endocarditis and Other Infections, Angiomyolipoma, Analgesic-Nephropathy, Anorexia Nervosa and Kidney Disease, Angiotensin Antibodies and Focal Segmental Glomerulosclerosis, Antiphospholipid Syndrome, Anti-TNF-α Therapy related Glomerulonephritis, APOL1 Mutations, Apparent Mineralocorticoid Excess Syndrome, Aristolochic Acid Nephropathy, Chinese Herbal Nephropathy, Balkan Endemic Nephropathy, Bartter Syndrome, Beeturia, β-Thalassemia Renal Disease, Bile Cast Nephropathy, BK Polyoma Virus Nephropathy in the Native Kidney, Bladder Rupture, Bladder Sphincter Dyssynergia, Bladder Tamponade, Border-Crossers' Nephropathy, Bourbon Virus and Acute Kidney Injury, Burnt Sugarcane Harvesting and Acute Renal Dysfunction, Byetta and Renal Failure, C1q Nephropathy, Cannabinoid Hyperemesis Acute Renal Failure, Cardiorenal syndrome, Carfilzomib-Induced Renal Injury, CFHR5 nephropathy, Charcot-Marie-Tooth Disease with Glomerulopathy, Cherry Concentrate and Acute Kidney Injury, Cholesterol Emboli, Churg-Strauss syndrome, Chyluria, Colistin Nephrotoxicity, Collagenofibrotic Glomerulopathy, Collapsing Glomerulopathy, Collapsing Glomerulopathy Related to CMV, Congenital Nephrotic Syndrome, Conorenal syndrome (Mainzer-Saldino Syndrome or Saldino-Mainzer Disease), Contrast Nephropathy, Copper Sulpfate Intoxication, Cortical Necrosis, Crizotinib-related Acute Kidney Injury, Cryoglobulinemia, Crystalglobulin-Induced Nephropathy, Crystal-Induced Acute Kidney injury, Cystic Kidney Disease, Acquired, Cystinuria, Dasatinib-Induced Nephrotic-Range Proteinuria, Dense Deposit Disease (MPGN Type 2), Dent Disease (X-linked Recessive Nephrolithiasis), Dialysis Disequilibrium Syndrome, Diabetes and Diabetic Kidney Disease, Diabetes Insipidus, Dietary Supplements and Renal Failure, Drugs of Abuse and Kidney Disease, Duplicated Ureter, EAST syndrome, Ebola and the Kidney, Ectopic Kidney, Ectopic Ureter, Edema, Swelling, Erdheim-Chester Disease, Fabry's Disease, Familial Hypocalciuric Hypercalcemia, Fanconi Syndrome, Fraser syndrome, Fibronectin Glomerulopathy, Fibrillary Giomerulonephritis and Immunotactoid Glomerulopathy, Fraley syndrome, Focal Segmental Glomeruloscierosis, Focal Sclerosis, Focal Glomerulosclerosis, Galloway Mowat syndrome, Giant Cell (Temporal) Arteritis with Kidney Involvement, Gestational Hypertension, Gitelman Syndrome, Glomerular Diseases, Glomerular Tubular Reflux, Glycosuria, Goodpasture Syndrome, Hair Dye Ingestion and Acute Kidney Injury, Hantavirus Infection Podocytopathy, Hematuria (Blood in Urine), Hemolytic Uremic Syndrome (HUS). Atypical Hemolytic Uremic Syndrome (aHUS), Hemophagocytic Syndrome, Hemorrhagic Cystitis, Hemorrhagic Fever with Renal Syndrome (HFRS, Hantavirus Renal Disease, Korean Hemorrhagic Fever, Epidemic Hemorrhagic Fever, Nephropathis Epidemica), Hemosiderosis related to Paroxysmal Nocturnal Hemoglobinuria and Hemolytic Anemia, Hepatic Glomerulopathy, Hepatic Veno-Occlusive Disease, Sinusoidal Obstruction Syndrome, Hepatitis C-Associated Renal Disease, Hepatorenal Syndrome, Herbal Supplements and Kidney Disease, High Blood Pressure and Kidney Disease, HIV-Associated Nephropathy (HIVAN), Horseshoe Kidney (Renal Fusion), Hunner's Ulcer, Hyperaldosteronism, Hypercalcemia, Hyperkalemia, Hypermagnesemia, Hypernatremia, Hyperoxaluria, Hyperphosphatemia, Hypocalcemia, Hypokalemia, Hypokalemia-induced renal dysfunction, Hypokalemic Periodic Paralysis, Hypomagnesemia, Hyponatremia, Hypophosphatemia, IgA Nephropathy, IgG4 Nephropathy, interstitial Cystitis, Painful Bladder Syndrome (Questionnaire), interstitial Nephritis, Ivemark's syndrome, Ketamine Associated Bladder Dysfunction, Kidney Stones, Nephrolithiasis, Kombucha Tea Toxicity, Lead Nephropathy and Lead-Related Nephrotoxicity, Leptospirosis Renal Disease, Light Chain Deposition Disease, Monoclonal Immunoglobuliti Deposition Disease, Liddle Syndrome, Lightwood-Albright Syndrome, Lipoprotein Glomerulopathy, Lithium Nephrotoxicity, LMX1B Mutations Cause Hereditary FSGS, Loin Pain Hematuria, Lupus, Systemic Lupus Erythematosis, Lupus Kidney Disease, Lupus Nephritis, Lupus Nephritis with Antineutrophil Cytoplasmic Antibody Seropositivity, Lyme Disease-Associated Giomerulonephritis, Malarial Nephropathy, Malignancy-Associated Renal Disease, Malignant Hypertension, Malakoplakia, Meatal Stenosis, Medullary Cystic Kidney Disease, Medullary Sponge Kidney, Megaureter, Melamine Toxicity and the Kidney, Membranoproliferative Glomerulonephritis, Membranous Nephropathy, MesoAmerican Nephropathy, Metabolic Acidosis, Metabolic Alkalosis, Methotrexate-related Renal Failure, Microscopic Polyangiitis, Milk-alkalai syndrome, Minimal Change Disease, MDMA (Molly; Ecstacy; 3,4-Methylenedioxymethamphetamine) and Kidney Failure, Multicystic dysplastic kidney, Multiple Myeloma, Myeloproliferative Neoplasms and Glomerulopathy, Nail-patella Syndrome, Nephrocalcinosis, Nephrogenic Systemic Fibrosis, Nephroptosis (Floating Kidney, Renal Ptosis), Nephrotic Syndrome, Neurogenic Bladder, Nodular Glomerulosclerosis, Non-Gonococcal Urethritis, Nutcracker syndrome, Orofaciodigital Syndrome, Orotic Aciduria, Orthostatic Hypotension, Orthostatic Proteinuria, Osmotic Diuresis, Ovarian Hyperstimulation Syndrome, Page Kidney, Papillary Necrosis, Papillorerial Syndrome, (Renal-Coloboma Syndrome, Isolated Renal Hypoplasia), Parvovirus B19 and the Kidney, The Peritoneal-Renal Syndrome, Posterior Urethral Valve, Post-infectious Glomerulonephritis, Post-streptococcal Glomerulonephritis, Polyarteritis Nodosa, Polycystic Kidney Disease, Posterior Urethral Valves, Preeclampsia, Propofol infusion syndrome, Proliferative Glomerulonephritis with Monoclonal IgG Deposits (Nasr Disease), Propolis (Honeybee Resin) Related Renal Failure, Proteinuria (Protein in Urine), Pseudohyperaldosteronism, Pseudohypobicarbonaternia, Pseudohypoparathyroidism, Pulmonary-Renal Syndrome, Pyelorieplaritis (Kidney infection), Pyonephrosis, Radiation Nephropathy, Ranolazine and the Kidney, Refeeding syndrome, Reflux Nephropathy, Rapidly Progressive Glomerulonephritis, Renal Abscess, Peripnephric Abscess, Renal Agenesis, Renal Arcuate Vein Microthrombi-Associated Acute Kidney injury, Renal Artery Aneurysm, Renal Artery Stenosis, Renal Cell Cancer, Renal Cyst, Renal Hypouricernia with Exercise-induced Acute Renal Failure, Renal Infarction, Renal Osteodystrophy, Renal Tubular Acidosis, Renin Secreting Tumors (Juxtagloinerular Cell Tumor), Reset Osinostat, Retrocaval Ureter, Rotroperitoneal Fibrosis, Rhabdomyolysis, Rhabdomyolysis related to Bariatric Surgery, Rheumatoid Arthritis-Associated Renal Disease, Sarcoidosis Renal Disease, Salt Wasting, Renal and Cerebral, Schistosomiasis and Glomerular Disease, Schipke immuno-osseous dysplasia, Scleroderma, Renal Crisis, Serpentine Fibula-Polycystic Kidney Syndrome, Exner Syndrome, Sickle Cell Nephropathy, Silica Exposure and Chronic Kidney Disease, Sri Lankan Farmers' Kidney Disease, Sjogren's Syndrome and Renal Disease, Synthetic Cannabinoid Use and Acute Kidney Injury, Kidney Disease Following Hematopoietic Cull Transplantation, Kidney Disease Related to Stem Cell Transplantation, Thin Basement Membrane Disease, Benign Familial Hematuria, Trigonitis, Tuberculosis, Genitourinary, Tuberous Sclerosis, Tubular Dysgenesis, immune Complex Tubulointerstitial Nephritis Due to Autoantibodies to the Proximal Tubule Brush Border, Tumor Lysis Syndrome, Uremia, Uremic Optic Neuropathy, Ureteritis Cystica, Ureterocele, Urethral Caruncle, Urethral Stricture, Urinary Incontinence, Urinary Tract Infection, Urinary Tract Obstruction, Vesicointestinal Fistula, Vesicoureteral Reflux, Volatile Anesthetics and Acute Kidney Injury, Von Hippel-Lindau Disease, Waldenstrom's Macroglobulinernic Glomerulonephritis, Warfarin-Related Nephropathy, Wasp Stings and Acute Kidney Injury, Wegener's Granulomatosis, Granulomatosis with Polyangiitis, West Nile Virus and Chronic Kidney Disease, and Wunderlich syndrome.

Various cardiovascular diseases may be treated with pharmaceutical compositions, AAV particles, of the present invention. As a non-limiting example, the cardiovascular disease may be Ischemic heart disease also known as coronary artery disease, cerebrovascular disease (Stroke), Peripheral vascular disease, Heart failure, Rheumatic heart disease, and Congenital heart disease.

Various antibody deficiencies may be treated with pharmaceutical compositions, AAV particles, of the present invention. As a non-limiting example, the antibody deficiencies may be X-Linked Agammaglobulinemia (XLA), Autosomal Recessive Agammaglobulinemia (ARA), Common Variable Immune Deficiency (CVID), IgG (IgG1 IgG2, IgG3 and IgG4) Subclass Deficiency, Selective IgA. Deficiency, Specific Antibody Deficiency (SAD), Transient Hypogammaglobulinemia of infancy, Antibody Deficiency with Normal or Elevated Immunoglobulins, Selective IgM Deficiency, Immunodeficiency with Thymoma (Good's Syndrome), Transcobalamin II Deficiency, Warts, Hypogammaglobulinemia Infection, Myelokathexis (WHIM) Syndrome, Drug-Induced Antibody Deficiency, Kappa Chain Deficiency, Heavy Chain Deficiencies, Post-Meiotic Segregation (PMS2) Disorder, and Unspecified Hypogammaglobulinemia.

Various ocular diseases may be treated with pharmaceutical compositions, AAV particles, of the present invention. As a non-limiting example, the ocular disease may be thyroid eye disease (TED), Graves' disease (GD) and orbitopathy, Retina Degeneration, Cataract, optic atrophy, macular degeneration, Leber congenital amaurosis, retinal degeneration, cone-rod dystrophy. Usher syndrome, leopard syndrome, photophobia, and photoaversion.

Various neurological diseases may be treated with pharmaceutical compositions. AAV particles, of the present invention. As a non-limiting example, the neurological disease may be Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign intracranial Hypertension, Bernhardt-Roth Syndrome, Binswanger's Disease, Blepharospasm, Bloch-Sulzherger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosortial Dominant Arteriopathy with Sub-cortical infarcts and Leukoencephalopathy (CADASJL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavernous Malformation, Cerebral Gigantism, Cerebral Hypoxia, Cerebral Palsy, Cerebro-Oculo-Facia-Skeletal Syndrome (COPS), Charcot-Mane-Tooth Disease, Chian Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Injection, Dancing Eyes-Dancing Feet Syndrome, Dandy-Walker Syndrome, Dawson Disease, De Morsier's Syndrome, Dejerine-Klumpke Palsy, Dementia, Dementia—Multi-infarct, Dementia—Semantic, Dementia—Subcortical, Dementia With Lewy Bodies, Dentate Cerebellar Ataxia, Dentatorubral Atrophy, Dennatomyositis, Developmental Dyspraxia, Devic's Syndrome, Diabetic Neuropathy, Diffuse Sclerosis, Dravet Syndrome, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, an ilial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Aiterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-I Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, inclusion Body Myositis, Incontinentia Pigmenti, Infantile Hypotonia, infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Klüver-Bucy Syndrome, Korsakofis Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-in Syndrome, Lou Gehrig's Disease, Lupus—Neurological Sequelae, Lyme Disease—Neurological Complications, Machado-Joseph Disease, Macrencephaly, Megalencephaly, Meikerson-Rosenthal Syndrome, Meningitis, Meningitis and Encephalitis, Menkes Disease, Meralgia Paresthetica, Metachromatic Leukodystrophy, Microcephialy, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy, Multiple System Atrophy with Orthostatic Fly potension, Muscular Dystrophy, Myasthenia—Congenital, Myasthenia Gravis, Myelinoclastic Diffuse Sclerosis, Myoclonic Encephalopathy of Infants, Myoclonus, Myopathy, Myopathy—Congenital, Myopathy—Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscniosis, Neuronal Migratioft Disorders, Neuropathy—Hereditary, Neurosarcoidosis, Neurosyphilis, Neuratoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain-Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Party-Romberg, Pelizaeus-Merzbacher Disease, Pena Shokeir II Syndrome, Perineural Cysts, Periodic, Paralyses, Peripheral Neuropathy, Peri Vefitricular Letikomalacia, Persistent Vegetative State, Pervasive Developmental Disorders, Phylanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Dentatum Atrophy, Primary-Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasniosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjögrens Syndrome, Sleep Apnea, Sleeping Sickness, Sotos Syndrome, Spasticity, Spina Bifida, Spinal Cord Infarction, Spinal Cord injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VEIL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, X-Linked Spinal and Bulbar Muscular Atrophy.

Various psychological disorders may be treated with pharmaceutical compositions, AAV particles, of the present invention. As a non-limiting example, the psychological disorders may be Aboulia, Absence epilepsy, Acute stress Disorder, Adjustment Disorders, Adverse effects of medication NOS, Age related cognitive decline, Agoraphobia, Alcohol Addiction, Alzheimer's Disease, Amnesia (also known as Amnestic Disorder), Amphetamine Addiction, Anorexia Nervosa, Anterograde amnesia, Antisocial personality disorder (also known as Sociopathy), Anxiety Disorder (Also known as Generalized Anxiety Disorder), Anxiolytic related disorders, Asperger's Syndrome (now part of Autism Spectrum Disorder), Attention Deficit Disorder (Also known as ADD), Attention Deficit Hyperactivity Disorder (Also known as ADHD), Autism Spectrum Disorder (also known as Autism), Autophagia, Avoidant Personality Disorder, Barbiturate related disorders, Benzodiazepine related disorders, Bereavement, Bibliomania, Binge Eating Disorder, Bipolar disorder (also known as Manic Depression, includes Bipolar I and Bipolar II), Body Dysmorphic Disorder, Borderline intellectual functioning, Borderline Personality Disorder, Breathing-Related Sleep Disorder, Brief Psychotic Disorder, Bruxism, Bulimia Nervosa, Caffeine Addiction, Cannabis Addiction, Catatonic disorder, Catatonic schizophrenia, Childhood amnesia, Childhood Disintegrative Disorder (now part of Autism Spectrum Disorder), Childhood Onset Fluency Disorder (formerly known as Stuttering), Circadian Rhythm Disorders, Claustrophobia, Cocaine related disorders, Communication disorder, Conduct Disorder, Conversion Disorder, Cotard delusion, Cyclothymia (also known as Cyclothymic Disorder), Delerium, Delusional Disorder, dementia, Dependent Personality Disorder (also known as Asthenic Personality Disorder), Depersonalization disorder (now known as Depersonalization/Derealization Disorder), Depression (also known as Major Depressive Disorder), Depressive personality disorder, Derealization disorder (now known as Depersonalization/Derealization Disorder), Dermotillomania, Desynchronosis, Developmental coordination disorder Diogenes Syndrome, Disorder of written expression, Dispareunia, Dissocial Personality Disorder, Dissociative Amnesia, Dissociative Fugue, Dissociative Identity Disorder (formerly known as Multiple Personality Disorder), Down syndrome, Dyslexia, Dyspareunia, Dysthymia (now known as Persistent Depressive Disorder), Eating disorder NOS, Ekbom's Syndrome (Delusional Parasitosis), Emotionally unstable personality disorder, Encopresis, Enuresis (bedwetting), Erotomania, Exhibitionistic Disorder, Expressive language disorder, Factitious Disorder, Female Sexual Disorders, Fetishistic Disorder, Folie á deux, Fregoli delusion, Frotteuristic Disorder, Fugue State, Ganser syndrome, Gambling Addiction, Gender Dysphoria (formerly known as Gender Identity Disorder), Generalized Anxiety Disorder, General adaptation syndrome, Grandiose delusions, Hallucinogen Addiction, Haltlose personality disorder, Histrionic Personality Disorder, Primary hypersomnia, Huntington's Disease, Hypoactive sexual desire disorder, Hypochondriasis, Hypomania, Hyperkinetic syndrome, Hypersomnia, Hysteria, Impulse control disorder, Impulse control disorder NOS, Inhalant Addiction, Insomnia, Intellectual Development Disorder, Intermittent Explosive Disorder, Joubert syndrome, Kleptomania, Korsakoff's syndrome, Lacunar amnesia, Language Disorder, Learning Disorders, Major Depression (also known as Major Depressive Disorder), major depressive disorder, Male Sexual Disorders, Malingering, Mathematics disorder, Medication-related disorder, Melancholia, Mental Retardation (now known as Intellectual Development Disorder), Misophonia, Morbid jealousy, Multiple Personality Disorder (now known as Dissociative Identity Disorder), Munchausen Syndrome, Munchausen by Proxy, Narcissistic Personality Disorder, Narcolepsy, Neglect of child, Neurocognitive Disorder (formerly known as Dementia), Neuroleptic-related disorder, Nightmare Disorder, Non Rapid Eye Movement, Obsessive-Compulsive Disorder, Obsessive-Compulsive Personality Disorder (also known as Anankastic Personality Disorder), Oneirophrenia, Onychophagia, Opioid Addiction, Oppositional Defiant Disorder, Orthorexia (ON), Pain disorder, Panic attacks, Panic Disorder, Paranoid Personality Disorder, Parkinson's Disease, Partner relational problem, Passive-aggressive personality disorder, Pathological gambling, Pedophilic Disorder, Perfectionism, Persecutory delusion, Persistent Depressive Disorder (also known as Dysthymia), Personality change due to a general medical condition, Personality disorder, Pervasive developmental disorder (PDD), Phencyclidine related disorder, Phobic disorder, Phonological disorder, Physical abuse, Pica, Polysubstance related disorder, Postpartum Depression, Post-traumatic embitterment disorder (PLED), Post Traumatic Stress Disorder, Premature ejaculation, Premenstrual Dysphoric Disorder, Psychogenic amnesia, Psychological factor affecting medical condition, Psychoneurotic personality disorder, Psychotic disorder, not otherwise specified, Pyromania, Reactive Attachment Disorder, Reading disorder, Recurrent brief depression, Relational disorder, REM Sleep Behavior Disorder, Restless Leg Syndrome, Retrograde amnesia, Retts Disorder (now part of Autism Spectrum Disorder), Rumination syndrome, Sadistic personality disorder, Schizoaffective Disorder, Schizoid Personality Disorder, Schizophrenia, Schizophreniform disorder, Schizotypal Personality Disorder, Seasonal Affective Disorder, Sedative, Hypnotic, or Anxiolytic Addiction, Selective Mutism, Self-defeating personality disorder, Separation Anxiety Disorder, Sexual Disorders Female, Sexual Disorders Male, Sexual Addiction, Sexual Masochism Disorder, Sexual Sadism Disorder, Shared Psychotic Disorder, Sleep Arousal Disorders, Sleep Paralysis, Sleep Terror Disorder (now part of Nightmare Disorder, Social Anxiety Disorder, Somatization Disorder, Specific Phobias, Stendhal syndrome, Stereotypic movement disorder, Stimulant Addiction, Stuttering (now known as Childhood Onset Fluency Disorder), Substance related disorder, Tardive dyskinesia, Tobacco Addiction, Tourettes Syndrome, Transient tic disorder, Transient global amnesia, Transvestic Disorder, Trichotillomania, Undifferentiated Somatoform Disorder, Vaginismus, and Voyeuristic Disorder.

Various lung diseases may be treated with pharmaceutical compositions, AAV particles, of the present invention. As a non-limiting example, the lung diseases may be Asbestosis, Asthma, Bronchiectasis, Bronchitis, Chronic Cough, Chronic Obstructive Pulmonary Disease (COPD), Croup, Cystic Fibrosis, Hantavirus, Idiopathic Pulmonary Fibrosis, Pertussis, Pleurisy, Pneumonia, Pulmonary Embolism, Pulmonary Hypertension, Sarcoidosis, Sleep Apnea, Spirometry, Sudden Infant Death Syndrome (SIDS), Tuberculosis, Alagille Syndrome, Autoinilinine Hepatitis, Biliary Atresia, Cirrhosis, ERCP (Endoscopic Retrograde Cholangiopancreatography), and Hemochromatosis. Nonalcoholic Steatohepatitis, Porphyria, Primary Biliary Cirrhosis, Primary Sclerosing Cholangitis.

Various bone diseases may be treated with pharmaceutical compositions, AAV particles, of the present invention. As a non-limiting example, the bone diseases may be osteoporosis, neurofibromatosis, osteogenesis imperfecta (OI), rickets, osteosarcoma, achondroplasia, fracture, osteomyelitis, Ewing tumour of bone, osteomalacia hip dysplasia, Paget disease of bone, marble bone disease, osteochondroma, bone cancer, bone disease, osteochondrosis, osteoma, fibrous dysplasia, cleidocranial dysostosis, osteoclastoma, bone cyst, metabolic bone disease, melorheostosis, callus, Caffey syndrome, and mandibulofacial dysostosis.

Various blood diseases may be treated with pharmaceutical compositions, AAV particles, of the present invention. As a non-limiting example, the blood diseases ma be Anemia and CKD (for health care professionals), Aplastic Anemia and Myelodysplastic Syndromes, Deep Vein Thrombosis, Hemochromatosis, Hemophilia, Henoch-Schönlein Purpura, Idiopathic Thrombocytopenic Purpura, Iron-Deficiency Anemia, Pernicious Anemia, Pulmonary Embolism, Sickle Cell Anemia, Sickle Cell Trait and Other Hemoglobinopathies, Thalassemia, Thrombotic Thrombocytopenic Purpura, and Von Willebrand Disease.

Various diseases associated with TNF-alpha may be treated with the pharmaceutical compositions, AAV particles, of the present invention. As a non-limiting example, the disease may be respiratory disorder; asthma; allergic and nonallergic asthma; asthma due to infection; asthma due to infection with respiratory syncytial virus (RSV); chronic obstructive pulmonary disease (COPD), a condition involving airway inflammation, eosinophilia; fibrosis and excess mucus production; cystic fibrosis; pulmonary fibrosis; an atopic disorder; atopic dermatitis; urticaria; eczema; allergic rhinitis; allergic enterogastritis; an inflammatory and/or autoimmune condition of the skin; an inflammatory and/or autoimmune condition of gastrointestinal organs, inflammatory bowel diseases (IBD); ulcerative colitis; Crohn's disease; an inflammatory and/or autoimmune condition of the liver; liver cirrhosis; liver fibrosis; liver fibrosis caused by hepatitis B and/or C virus, scleroderma; tumors or cancers; hepatocellular carcinoma; glioblastoma; lymphoma; Hodgkin's lymphoma; a viral infection; a bacterial infection; a parasitic infection; HTLV-1 infection; suppression of expression of protective type 1 immune responses, and suppression of expression of a protective type 1 immune response during vaccination, rheumatoid arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's Chorea, Parkinson's disease, Alzheimer's disease, stroke, primary biliary cirrhosis, hemolytic anemia, malignancies, heart failure, myocardial infarction Addison's disease, sporadic, polyglandular deficiency type I and poly glandular deficiency type II, Schmidt's syndrome, adult (acute) respiratory distress syndrome, alopecia, alopecia greata, seronegative arthropathy, arthropathy, Reiter's disease, psoriatic arthropathy, ulcerative colitic arthropathy, enteropathic synovitis, chlamydia, yersinia and salmonella associated arthropathy, spondyloarthropathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, hepatitis B, hepatitis C, common varied immunodeficiency (common variable hypogammagiobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing Cholangitis, psoriasis type 1, psoriasis type 2, idiopathic leucopaenia, autoimmune neutropaenia, renal disease NOS, glomerulonephritides, microscopic vasculitis of the kidneys, Lyme, disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis. Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver choleostasis, idiosyncratic liver disease, drug-Induced hepatitis, non-alcoholic steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma) abetalipoproteinemia, acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti-CD3 therapy, antiphospholipid syndrome, antireceptor hypersensitivity reactions, aortic and peripheral aneurysms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic Myelocylic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, corpulmonale, coronary artery disease, Creutzfeldt-Jakob disease, culture negative sepsis, cystic fibrosis, cytokine therapy associated disorders, dementia pugilistica, demyelinating diseases, dengue hemorrhagic fever, dermatitis, dermatologic conditions, diabetes, diabetes mellitus, diabetic arteriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, Epstein-Barr virus infection, erythromelalgia, extrapyramidal and cerebellar disorders, familial hemophagocytic lymphohistiocytosis, fetal thymus implant rejection. Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallervorden-Spatz disease, Hashimoto's thyroiditis, hay fever, heart transplant rejection, hemochromatosis, hemodialysis, hemolytic uremic syndrome/thrombolytic thrombocytopenic purpura, hemorrhage, hepatitis (A), His bundle arrhythmias, HIV infection/HIV neuropathy, Hodgkin's disease, hyperkinetic movement disorders, hypersensitivity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis (JRA), juvenile spinal muscular atrophy, Kaposi's sarcoma, kidney transplant rejection, legionella leishmaniasis, leprosy, lesions of the corticospinal system, lipedema, liver transplant rejection, lymphederna, malaria, malignant lymphoma, malignant histiocytosis, malignant melanoma, meningitis, meningococcemia, metabolic/idiopathic, migraine headache, mitochondrial multi-system disorder, mixed connective tissue disease, monoclonal gammopathy, myeloma, multiple systems degenerations (Menzel, Dejerine-Thomas, Shy-Drager, and Machado-Joseph), *Myasthenia gravis, Mycobacterium avium* intracellulare, *Mycobacterium tuberculosis*, myelodysplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-Hodgkins lymphoma, occlusion of the abdominal aorta and its branches, occlusive arterial disorders, OKT3® therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherosclerotic disease, peripheral vascular disorders, peritonitis, pernicious anemia, *Pneumocystis carinii* pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, progressive supranucleo palsy, primary pulmonary hypertension, radiation therapy, Raynaud's phenomenon and disease, Raynaud's disease, Refsum's disease, regular narrow QRS tachycardia, renovascular hypertension, reperfusion injury, restrictive cardiomyopathy, sarcomas, scleroderma, senile chorea, senile dementia of Lewy body type, seronegative arthropathies, shock, sickle cell anemia, skin allograft rejection, skin changes syndrome, small bowel transplant rejection, solid tumors, specific arrhythmias, spinal ataxia, spinocerebellar degenerations, streptococcal myosins, structural lesions of the cerebellum, subacute sclerosing panencephalitis, syncope, syphilis of the cardiovascular system, systemic anaphylaxis, systemic inflammatory response syndrome, systemic onset juvenile rheumatoid arthritis, T-cell or FAB ALL, telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, viral encephalitis/aseptic meningitis, viral-associated hemophagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, alopecia greata, anaphylaxis, anti-phospholipid antibody syndrome, aplastic anemia, arteriosclerosis, atopic eczema, atopic dermatitis, autoimmune dermatitis, autoimmune disorder associated with streptococcus infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischernia cicatricial pemphigoid, clinically isolated syndrome (CIS) with risk for multiple sclerosis, conjunctivitis, childhood onset psychiatric disorder, chronic obstructive pulmonary disease (COPD), dacryocystitis, dermatomyositis, diabetic retinopathy, diabetes mellitus, disk herniation, disk prolapse, drug induced immune hemolytic anemia, endocarditis, endometriosis, endophthalmitis, episcleritis, erythema multiforme, erythema multiforme major, gestational pemphigoid, Guillain-Barre syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratojunctivitis, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myasthenia gravis, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery disease (PAD), phlebitis, polyarteritis nodosa (or periarteritis nodosa), polychondris, polymyalgia rheumatica, poliosis, polyarticular JRA, polyendocrine deficiency syndrome, polymyositis, polymyalgia rheumatica (PMR), post-pump syndrome, primary Parkinsonism, prostate and rectal cancer and hematopoietic malignancies (leukemia and lymphoma), prostatitis, pure red cell aplasia, primary adrenal insufficiency, recurrent neuronwelitis optica, restenosis, rheumatic heart disease, sapho (synovitis, acne, pustulosis, hyperostosis, and osteitis), scleroderma, secondary amyloidosis, shock lung, scleritis, sciatica, secondary adrenal insufficiency, silicone associated connective tissue disease, Sneddon-Wilkinson dermatosis, spondylitis ankylosans, Stevens-Jonson syndrome (SJS), systemic inflammatory response syndrome, temporal arteritis, toxoplasmic retinitis, toxic epidermal necrolysis, transverse myelitis, TRAPS (tumor necrosis factor receptor associated periodic syndrome), type I allergic reaction, type II diabetes, urticaria, usual interstitial pneumonia (LIP), vasculitis, vernal conjunctivitis, viral retinitis, Vogt-Koyanagi-Harada syndrome (VKH syndrome), wet macular degeneration, wound healing, yersinia or salmonella associated arthropathy.

Various receptor for advanced glycation endproducts (RAGE) diseases may be treated with the pharmaceutical compositions, AAV particles, of the present invention. As a non-limiting example, the disease may be Amyotrophic Lateral Sclerosis, Brachial Plexus Injury, Brain Injury, including traumatic brain injury, Cerebral Palsy, Friedrich's Ataxia, Guillain Barre, Leukodystrophies, Multiple Sclerosis, Post Polio, Spina Bifida, Spinal Cord Injury, Spinal Muscle Atrophy, Spinal Tumors, Stroke, Transverse Myelitis, dementia, senile dementia, mild cognitive impairment, Alzheimer-related dementia, Huntington's chorea, tardive dyskinesia, hyperkinesias, manias, Morbus Parkinson, steel-Richard syndrome, Downs syndrome, myasthenia ciravis, nerve trauma, vascular amyioidosis, cerebral hemorrhage I with amyloidosis, brain inflammtion, Friedrich's ataxia, acute confusion disorder, amyotrophic lateral sclerosis, glaucoma, Alzheimer's disease, diabetic nephropathy, sepsis, rheumatoid arthritis and related inflammatory diseases.

Various neurite degenerative diseases may be treated with the pharmaceutical compositions, AAV particles, of the present invention. As a non-limiting example, the disease may be multiple sclerosis. Parkinson's disease, Alzheimer's disease, Tay-Sachs disease, Niemann-Pick disease, Gaucher's disease, Hurler's syndrome, Huntington's disease, amyotrophic lateral sclerosis, idiopathic inflammatory demyelinating diseases, vitamin B12 deficiency, central pontine myelinolysis, tabes dorsalis, transverse myelitis, Devic's disease, progressive multifocal leukoencephalopathy, optic neuritis, traumatic injury to the CNS, an ischemic cerebral stroke, glaucoma, diabetic retinopathy, age-dependent macular degeneration, and a leukodystrophy.

Various neurological diseases may be treated with the pharmaceutical compositions, AAV particles, of the present invention. As a non-limiting example, the disease may be Amyotrophic Lateral Sclerosis, Brachial Plexus Injury, Brain Injury, including traumatic brain injury, Cerebral Palsy, Guillain Barre, Leukodystrophies, Multiple Sclerosis, Post Polio, Spina Bifida, Spinal Cord Injury, Spinal Muscle Atrophy, Spinal Tumors, Stroke, Transverse Myelitis; dementia, senile dementia, mild cognitive impairment, Alzheimer-related dementia, Huntington's chorea, tardive dyskinesia, hyperkinesias, manias, Morbus Parkinson, steel-Richard syndrome, Down's syndrome, myasthenia gravis, nerve trauma, vascular amyloidosis, cerebral hemorrhage I with amyloidosis, brain inflammation, acute confusion disorder, amyotrophic lateral sclerosis, glaucoma and Alzheimer's disease.

Various cancers may be treated with pharmaceutical compositions, AAV particles, of the present invention. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the AAV particles of the present invention include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphornalleukemia, squamous cell carcinoma, small cell carcinoma, large cell undifferentiated carcinomas, basal cell carcinoma and sinonasal undifferentiated carcinoma.

Types of sarcomas which may be treated with the AAV particles of the present invention include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the cancer which may be treated may be Acute granulocytic leukemia, Acute lymphocytic leukemia, Acute elogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stein glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Genn cell tumor, Glioblastoma multiforme, Glioma, Hairy cell leukemia, Head and neck cancer, Hemangioendothelioma, Hodgkin lymphoma, Hodgkins disease, Hodgkin's lymphoma, Hypopharyngeal cancer, infiltrating ductal carcinoma, infiltrating lobular carcinoma, Inflammatory breast cancer, Intestinal Cancer, Intrahepatic bile duct cancer, invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullar carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soil tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

Diagnostic Applications

The AAV particles of the present invention may be used for diagnostic purposes or as diagnostic tools for any of the aforementioned diseases or disorders. As a non-limiting example, the AAV particles of the present invention or the antibodies encoded within the viral genome therein may be used as a biomarker for disease diagnosis. As a second non-limiting example, the AAV particles of the present invention or the antibodies encoded within the viral genome therein may be used for diagnostic imaging purposes, e.g., Mill PET, CT or ultrasound.

Preventative Applications

The AAV particles of the present invention or the antibodies encoded by the viral genome therein may be used to prevent disease or stabilize the progression of disease. In one embodiment, the AAV particles of the present invention are used to as a prophylactic to prevent a disease or disorder in the future. In one embodiment, the AAV particles of the present invention are used to halt further progression of a disease or disorder. As a non-limiting example, the AAV particles of the invention may be used in a manner similar to that of a vaccine.

Research Applications

The AAV particles of the present invention or the antibodies encoded by the viral genome therein may also be used as research tools. The AAV particles of the invention may be used as in any research experiment, e.g., in vivo or in vitro experiments. In a non-limiting example, the AAV particles of the invention may be used in cultured cells. The cultured cells may be derived from any origin known to one with skill in the art, and may be as non-limiting examples, derived from a stable cell line, an animal model or a human patient or control subject. In a non-limiting example, the AAV particles of the invention may be used in in vivo experiments in animal models (i.e., mouse, rat, rabbit, dog, cat, non-human primate, guinea pig, tenet, c-elegans, drosophila, zebrafish, or any other animal used for research purposes, known in the art) in another non-limiting example, the AAV particles of the invention may be used in human research experiments or human clinical trials.

Combination Applications

The AAV particles of the invention may be used as a combination therapy with any other therapeutic molecule known in the art. The therapeutic molecule may be approved by the US Food and Drug Administration or may be in clinical trial or at the preclinical research stage. The therapeutic molecule may utilize any therapeutic modality known in the art, with non-limiting examples including gene silencing or interference (i.e., miRNA, siRNA, RNAi, shRNA), gene editing (i.e., TALEN, CRISPR/Cas9 systems, zinc finger nucleases), and gene, protein or enzyme replacement.

Therapeutic Applications

The present disclosure additionally provides a method for treating non-infectious diseases and/or disorders in a mammalian subject, including a human subject, comprising administering to the subject any of the AAV particles or pharmaceutical compositions of the invention. In some embodiments, non-infectious diseases and/or disorders treated according to the methods described herein include, but are not limited to, Parkinson's Disease (PD), Dementia with Lewy Bodies (DLB), Multiple System Atrophy (MSA), Decreased muscle mass, Spinal muscular atrophy (SMA) Alzheimer's disease (AD), Amyotrophic lateral sclerosis (ALS), Huntington's Disease (HD), Multiple sclerosis (MS), Stroke, Migraine, Pain, Neuropathies, Psychiatric disorders including schizophrenia, bipolar disorder, and autism, Cancer, ocular diseases, systemic diseases of the blood, heart and bone, Immune system and Autoimmune diseases and inflammatory diseases.

In some embodiments, methods of treating non-infectious diseases and/or disorders in a subject in need thereof may comprise the steps of: (1) deriving, generating and/or selecting an antibody, antibody-based composition or fragment thereof that targets the antigen of interest; (2) producing an AAV particle with a viral genome that includes a payload region encoding the selected antibody of (1); and (3) administering the AAV particle (or pharmaceutical composition thereof) to the subject.

The present disclosure provides a method for administering to a subject in need thereof, including a human subject, a therapeutically effective amount of the AAV particles of the invention to slow, stop or reverse disease progression. As a non-limiting example, disease progression may be measured by tests or diagnostic tool(s) known to those skilled in the art. As another non-limiting example, disease progression may be measured by change in the pathological features of the brain, CSF or other tissues of the subject.

Parkinson's Disease

Parkinson's Disease (PD) is a progressive disorder of the nervous system affecting especially the substantia nigra of the brain. PD develops are a result of the loss of dopamine producing brain cells. Typical early symptoms of PD include shaking or trembling of a limb, e.g. hands, arms, legs, feet and face. Additional characteristic symptoms are stiffness of the limbs and torso, slow movement or an inability to move, impaired balance and coordination, cognitional changes, and psychiatric conditions e.g. depression and visual hallucinations. PD has both familial and idiopathic forms and it is suggestion to be involved with genetic and environmental causes. PD affects more than 4 million people worldwide. In the US, approximately 60,000 cases are identified annually. Generally, PD begins at the age of 50 or older. An early-onset form of the condition begins at age younger than 50, and juvenile-onset PD begins before age of 20.

Death of dopamine producing brain cells related to PD has been associated with aggregation, deposition and dysfunction of alpha-synuclein protein (see, e.g. Marques and Outeiro. 2012, *Cell Death Dis.* 3:e350, Jenner, 1989, *J Neural Neurosurg Psychiatry*. Special Supplement, 22-28, and references therein). Studies have suggested that alpha-synuclein has a role in presynaptic signaling, membrane trafficking and regulation of dopamine release and transport. Alpha-synuclein aggregates, e.g. in forms of oligomers, have been suggested to be species responsible for neuronal dysfunction and death. Mutations of the alpha-synuclein gene (SNCA) have been identified in the familial forms of PD, but also environmental factors, e.g. neurotoxin affect alpha-synuclein aggregation. Other suggested causes of brain cell death in PD are dysfunction of proteosomal and lysosomal systems, reduced mitochondrial activity.

PD is related to other diseases related to alpha-synuclein aggregation, referred to as "synucleinopathies." Such diseases include, but are not limited to, Parkinson's Disease Dementia (PDD), multiple system atrophy (MSA), dementia with Lewy bodies, juvenile-onset generalized neuroaxonal dystrophy (Hallervorden-Spatz disease), pure autonomic failure (PAF), neurodegeneration with brain iron accumulation (NBIA-1) and combined Aliheimer's and Parkinson's disease.

As of today, no cure or prevention therapy for PD has been identified. A variety of drug therapies available provide relief to the symptoms. Non-limiting examples of symptomatic medical treatments include carbidopa and levodopa combination reducing stiffness and slow movement, and anticholinergics to reduce trembling and stiffness. Other optional therapies include e.g. deep brain stimulation and surgery. There remains a need for therapy affecting the underlying pathophysiology. For example, antibodies targeting alpha.-synuclein, protein, or other proteins relevant for brain cell death in PD, may be used to prevent and/or treat PD.

In some embodiment, methods of the present invention may be used to treat subjects suffering from PD and other synucleinopathies. In some cases, methods of the present invention may be used to treat subjects suspected of developing PD and other synucleinopathies.

AAV Particles and methods of using the AAV particles described in the present invention may be used to prevent, manage and/or treat PD. As a non-limiting, example, the AAV particles of the present invention comprise a nucleic acid sequence encoding at least one of the sequences described in Table 3 (SEQ ID NO: 2948-17938).

Dementia with Lewy Bodies

Dementia with Lewy Bodies (DLB), also known as diffuse Lewy body disease, is a form of progressive dementia, characterized by cognitive decline, fluctuating alertness and attention, visual hallucinations and parkinsonian motor symptoms. DLB may be inherited by an autosomal dominant pattern. DLB affects more than 1 million individuals in the US. The condition typically shows symptoms at the age of 50 or older.

DLB is caused by the abnormal build-up of Lowy bodies, aggregates of the alpha-synuclein protein, in the cytoplasm of neurons in the brain areas controlling memory and motor control. The pathophysiology of these aggregates is very similar to aggregates observed in Parkinson's disease and DLB also has similarities to Alzheimer's disease. Inherited DLB has been associated with gene mutations in SNCA and SNCB genes, producing synuclein proteins.

As of today, there is no cure or prevention therapy for DLB. A variety of drug therapies available are aimed at managing the cognitive, psychiatric and motor control symptoms of the condition. Non-limiting examples of symptomatic medical treatments include e.g. acetylchohnesterase inhibitors to reduce cognitive symptoms, and levodopa to reduce stiffness and loss of movement. There remains a need for therapy affecting the underlying pathophysiology. Antibodies targeting alpha-synuclein protein may be used to prevent and/or treat DLB.

In some embodiment, methods of the present invention may be used to treat subjects suffering from DLB. In some cases, methods of the present invention may be used to treat subjects suspected of developing DLB.

AAV Particles and methods of using the AAV particles described in the present invention may be used to prevent, manage and/or treat DLB. As a non-limiting example, the AAV particles of the present invention comprise a nucleic acid sequence encoding at least one of the sequences described in Table 3 (SEQ ID NO: 2948-17938).

Multiple System Atrophy

Multiple system atrophy (MS), also known as Shy-Drager Syndrome, is a progressive neurodegenerative disorder. The characteristic symptoms are associated with failure of autonomic nervous system causing dizziness, fainting, bladder control problems, and problems regulating heart rate, blood pressure and breathing, accompanied by motor control symptoms similar to Parkinson's disease, e.g. tremor, rigidity and loss of muscle coordination. The symptoms are a reflection of the loss of nerve cells in certain areas of the brain and spinal cord. The disease typically develops around ages of 50 or 60 years. MSA affects approximately 50,000 individuals in the US.

MSA belongs to the synucleinopathies and is characterized by the appearance of glial cytoplasmic inclusions (Gus) in oligodendrocytes, which are the myelin producing support cells of the central nervous system (see, e.g. Teasel et al. 2014, *Acta Neuropatholagica Communications*, 2014, 2:15, and references therein). GCIs comprise insoluble proteinaceous filaments composed of the alpha-synuclein protein. Also, tau proteins have been identified in GCIs. The pathophysiology of the CGIs is not yet fully understood but alpha-synuclein and tau proteins are suggested to have a role in the development and progression of SMA.

As of today, there is no cure or prevention therapy for MSA. A variety of drug therapies available are aimed at managing the symptoms. Non-limiting examples of symptomatic medical treatments include those used for Parkinson's disease to relief symptoms related motor movement, increased salt intake and steroid hormones for increasing blood pressure. There remains a need for therapy affecting the underlying pathophysiology. Antibodies targeting tau and alpha.-synuclein proteins may be used to prevent and/or treat MSA.

In some embodiment, methods of the present invention may be used to treat subjects suffering from MSA. In some cases, methods of the present invention may be used to treat subjects suspected of developing MSA.

AAV Particles and methods of using the AAV particles described in the present invention may be used to prevent, manage and/or treat MSA. As a non-limiting example, the AAV particles of the present invention comprise a nucleic acid sequence encoding at least one of the sequences described in Table 6 (SEQ ID NO: SEQ ID NO: 2948-2970, 3018-3046, 3056-3076, 3110-3130, 3132-3177, 3181-3196, 32.42-3268, 3275-3285, 3315-3336, 3338-3371, 3375-3382, 4268-4494).

Decreased Muscle Mass, Muscle Strength and Muscle Function

A number of diseases, disorders and condition are associated with muscle weakness, which refers to reduced muscle mass, muscle strength and muscle function. For example, such disorders include myopathies, which are neuromuscular disorders characterized by muscle weakness due to dysfunction of muscle fiber. Myopathies include, but are not limited to, congenital myopathies, muscular dystrophies, mitochondrial myopathies, glycogen storage diseases of muscle, myoglobinurias, dermatomyositis, myositis ossificans, familial periodic paralysis, polymyositis, inclusion body myositis, and related myopathies, neurornyotonia, stiff-man syndrome, common muscle cramps and stiffness, and tetany. Muscle weakness may also be caused by ageing, diabetes, obesity, chronic pain, peripheral vascular disease, chronic lung diseases, heart diseases, cancers, anemia, arthritis, chronic renal failure and renal diseases, chronic obstructive pulmonary disease, multiple sclerosis (MS), stroke, muscular dystrophy, motor neuron neuropathy, amyotrophic lateral sclerosis (ALS), Parkinson's disease, osteoporosis, osteoarthritis, fatty acid liver disease, liver cirrhosis, Addison's disease. Cushing's syndrome, acute respiratory distress syndrome, steroid induced muscle wasting, myositis, scoliosis, or infections e.g influenza, Epstein-Barr virus infection, HIV/AIDS, Lyme disease, and hepatitis C infection. Muscle weakness may occur after surgery, burn trauma, medical treatment, or trauma through an injury. Severity of muscle weakness varies. In many cases the condition reduces the quality of life significantly, or may be even life-threatening.

A regulator protein associated with muscles is Myostatin (MSTN), also known as growth and differentiation factor 8 (GDF-8). Myostatin is a protein encoded by the MSTN gene, released in the myocytes. Myostatin and myostatin receptors (e.g. ACVR2A aud ACVR2B), have a role in suppressing the growth and development of muscle tissue in the body.

Treatment of muscle weakness depends on the underlying disease or condition, and may include e.g. drug therapy, good nutrition, physiotherapy, mechanical support for weakened muscles and/or surgery. However, efficient therapy to treat a combination of loss of muscle Mass, muscle strength and muscle function are needed. Antibodies targeting myostatin be used in the treatment and prophylaxis of diseases associated with such conditions. For example, himagrumab (developed by Novartis) is a monoclonal antibody targeting ACVR2B myostatin receptor, and used for therapy of musculoskeletal diseases and domagrozumab (developed by Pfizer) is an antibody targeting triyostatin, and used for therapy of muscle degeneration and muscle weakness.

In some embodiment, methods of the present invention may be used to treat subjects suffering from loss of muscle mass, muscle strength and muscle function. In some cases, methods of the present invention may be used to treat subjects suspected of developing such conditions.

AAV Particles and methods of using the AAV particles described in the present invention may be used to prevent, manage and/or treat MSA. As a non-limiting example, the AAV particles of the present invention comprise a nucleic acid sequence encoding at least one of the sequences described in Table 6 (SEQ ID NO: SEQ ID NO: 2948-2970, 3018-3046, 3056 3076, 3110-3130, 3132-3177, 3181-3196, 3242-3268, 3275-3285, 3315-3336, 3338-3371, 3375-3382, 4268-4494).

Spinal Muscular Atrophy

Spinal muscular atrophy (SMA) is a hereditary disease causing weakness and wasting of the voluntary muscles in the arms and legs of infants and children. SMA is associated with abnormalities in the protein production of the survival motor neuron gene 1 (SMN1). Lack of the protein affects degeneration and death of lower motor neurons. Typical symptoms include floppy limbs and trunk, feeble movement of the arms and legs, difficulties in swallowing and eating, and impaired breathing. SMA is the most common genetic disorder leading to death of children under 2 years of age. SMA affects one in 6,000 to 10,000 people.

As of today, there is no cure for SMA. Therapies available are aimed at management of the symptoms and prevention of additional complications. Such therapies are associated e.g. with cardiology, movement management, respiratory care and mental health. There remains a need for therapy affecting the underlying pathophysiology of SMA.

In some embodiment, methods of the present invention may be used to treat subjects suffering from SMA. In some cases, methods of the present invention may be used to treat subjects suspected of developing SMA.

AAV Particles and methods of using the AAV particles described in the present invention may be used to prevent, manage and/or treat SMA. As a non-limiting example, the AAV particles of the present invention comprise a nucleic acid sequence encoding at least one of the sequences described in Table 6 (SEQ ID NO: SEQ ID NO: 2948-2970, 3018-3046, 3056-3076, 3110-3130, 3132-3177, 3181-3196, 3242-3268, 3275-3285, 3315-3336, 3338-3371, 3375-3382, 4268-4494).

Alzheimer's Disease

Alzheimer's Disease (AD) is a debilitating neurodegenerative disease and the most common form of dementia affecting the memory, thinking and behavior. Typical early symptom is difficulty of remembering newly learned information. As the disease adsances, symptoms include disorientation, changes in sleep, changes in mood and behavior, confusion, unfound suspicions and eventually difficulty to speak, swallow and walk. AD currently afflicts more than 35 million people worldwide, with that number expected to double in coming decades.

As of today, no cure or prevention therapy for AD has been identified. Drug therapy to treat memory loss, behavioral changes and sleep changes, and to slow down the progression of AD are available. However, these symptomatic treatments do not address the underlying pathophysiology.

The AD brain is characterized by dual aggregates, the extracellular β-amyloid plaques and the intracellular neurofibrillary tangles (NFT) of misfolded, hyperphosphorylated microtubule associated, tau proteins. The β-amyloid plaques may lead to pathological cascades that are associated with a number of proteins, such as, but not limited to, APP (amyloid beta (A4) precursor protein), A beta (amyloid beta), BACE (Beta-secretases), and APOE (apolipoprotein E). Historically, it has been thought that amyloid pathology precedes the appearance of NET, and therefore, that tau pathology in the form of aggregates is symbolic of impending cell death (Selkoe, D. J., 2001, *Physiological Reviews*, 81(2):741-66). However, clinical trials addressing amyloid pathology have largely failed thus far and advances in the field suggest that targeting tau aggregates may be advantageous and lead to improved cognitive In some embodiment, methods of the present invention may be used to treat subjects suffering from AD. In some cases, methods of the present invention may be used to treat subjects suspected of developing AD.

AAV Particles and methods of using the AAV particles described in the present invention may be used to prevent, manage and/or treat AD. As a non-limiting example, the AAV particles of the present invention comprise a nucleic acid sequence encoding at least one of the sequences described in Table 4 (SEQ ID NO: 2948-2970, 2977-2998, 3018-3046, 3056-3076, 3110-3177, 3181-3196, 3205-3226, 3242-3268, 3275-3285, 3315-3371, 3375-3382, 3385-4258).

Huntington's Disease

Huntington's disease (HD) is a rare, inherited disorder causing degeneration of neurons in the motor control region of the brain, as well as other areas. Typical symptoms of the disease include uncontrolled movements (chorea), abnormal postures, impaired coordination, slurred speech and difficulty of feeding and swallowing accompanied by changes in behavior, judgment and cognition. HD is caused by mutations in the gene associated with the huntingtin (HTT) protein. The mutation causes the (CAG) blocks of DNA to repeat abnormally many times. HD affects approximately 30, 000 individuals in the US.

HD is characterized by mutations of the huntingtin (HTT) protein with abnormal expansions of polyglutamine tracts, e.g. expansion of the length of glutamine residues encoded by CAG repeats. The expansion threshold for occurrence of the disease is considered to be approximately 35-40 residues. HD is also associated with beta sheet rich aggregates in striatal neurons formed by N-terminal region of HTT. The expansions and aggregates lead to gradual loss of neurons as HD progresses. Additionally, the cell death in HD is associated with death receptor 6 (DR6) which is known to induce apoptosis.

As of today, there is no therapy to cure, or prevent the progression of the disease. Drug therapies available are aimed at management of the symptoms. For example, FDA has approved tetrabenazine to be prescribed for prevention of chorea. Additionally, e.g. antipsychotic drugs may help to control delusions, hallucinations and violent outbursts. There remains a need for therapy affecting the underlying pathophysiology, such as antibody therapies targeting the HTT protein, DR6 protein, and/or other HD associated proteins.

In some embodiment, methods of the present invention may be used to treat subjects suffering from HD. In some cases, methods of the present invention may be used to treat subjects suspected of developing HD.

AAV Particles and methods of using the AAV particles described in the present invention may be used to prevent, manage and/or treat HD. As a non-limiting example, the AAV particles of the present invention comprise a nucleic acid sequence encoding at least one of the sequences described in Tables (SEQ ID NO: 2948-2970, 3018-3021, 3031-3046, 3056-3076, 3110-3130, 3132-3160, 3164-3177, 3181-3196, 3242-3246, 3257-3268, 3275-3285, 3315-3336, 3338-3371, 3375-3382 4259-4267).

Multiple Sclerosis

Multiple sclerosis is a disease of the central nervous system (CNS). The typical early symptoms occurring between the ages of 20 to 40 include blurring vision, red-green color distortion, partial blindness, extreme muscle weakness, feeling of numbness or prickling, difficulties with coordination and balance. In severe cases MS may lead to a partial or complete paralysis. MS is believed to be an autoimmune disease as the communication between the brain and other parts of the body being disrupted as the immune system causes an inflammation within the central nervous system. MS is caused by both genetic and environmental factors, e.g. viral infections. MS is the most common neurological condition of young adults globally, affecting more than 2.3 million individuals.

At present time, the pathophysiology of MS is not full understood. The disease is associated with a complex combination related to formation of lesions in the central nervous system, inflammation and demyelination (destruction of the protective myelin surrounding the nerve fibers) in white matter and cortex, and axon destruction (see, e.g. Longbrake et al., 2013, Curr Neural Neurasci Rep., 13(11), and references therein). A number of myelin inhibitory proteins have been characterized in association with MS, including, but not limited to, NogoA ((Neurite outgrowth inhibitor A), Nogo receptor-1 (NgR1), Myelin associated glycoprotein (MAG), oligodendrocyte glycoprotein (OMgp), LINGO-1 (Leucine rich repeat and immunoglobin-like domain-containing protein 1), and MAI (myelin associated inhibitor). MS is also affiliated with many immune response related proteins. Non-limiting examples of such proteins include e.g. B-cell and T-cell associated proteins, such as, hut not limited to, leukocyte surface antigen CD52, alpha chain of the IL-2 receptor CD25, B-cell surface molecule CD20, T helper cell CD4, and/or cytokine IL-12/23. Alpha 4-integrin, has been associated with inflammation of CNS, as it has a role in leukocyte adhesion and migration to the inflamed CNS. Additionally, MS patients have been characterized with elevated tumor necrosis factor (TNF) levels.

As of today, there is no prevention therapy or cure for MS. Patients in need of medical therapy may be treated with e.g. synthetic form of myelin basic protein. (Copaxone, copolymer 1), antiviral proteins knows a as interferons, or immunosuppressant drugs e.g. mitoxantore. Some drugs are aimed at treating a symptom of MS, such as dalapridine, which is aimed at improving walking of individuals with MS. Antibodies for MS have been developed. For example, natalizumab is a monoclonal antibody targeting alpha 4 integrin, (developed by Elan Pharmaceuticals and Biogen) approved by the FDA for treatment of relapsing MS under treatment guidelines to monitor patients by physicians. Other non-limiting examples for MS antibody drugs include alemtuzurnab (CD52), dacliziunab (CD25), rituximab (CD20), ocrelizumab (CD20), ofahimumab (CD20), (see, e.g Longbrake et al., 2013, Curr Neurol Neurosci Rep., 13(11), and references therein). However, many current medications have serious side effects, and there remains a need for therapy affecting the underlying pathophysiology, such as improved antibody therapies.

In some embodiment, methods of the present invention may be used to treat subjects suffering from MS. In some cases, methods of the present invention may be used to treat subjects suspected of developing MS.

AAV Particles and methods of using the AAV particles described in the present invention may be used to prevent, manage and/or treat MS. As a non-limiting example, the AAV particles of the present invention comprise a nucleic acid sequence encoding at least one of the sequences described in Table 6 (SEQ ID NO: 2948-2970, 3018-3046, 3056-3076, 3110-3130, 3132-3177, 3181-31%, 3242-3268, 3275-3285, 331.5-3336, 3338-3371, 3375-3382, 4268-4494).

Amyotrophic Lateral Sclerosis

Amyotrophic Lateral Sclerosis (ALS), also known as Lou Gehrig's disease or classical motor neuron disease, is a rapidly progressive and fatal neurological disease. ALS is associated with cell degeneration and death of the upper and lower motor neurons, leading to enablement of muscle movement, weakening, wasting and loss of control over voluntary muscle movement. Early symptoms include muscle weakness of hands, legs and swallowing muscles, eventually progressing to inability to breathe due to diaphragm failure. According to Centers for Disease Control and Prevention (CDC), ALS affects an estimated 12,000-15,000 individuals in the About 5-10% of cases are familial.

ALS, as other non-infectious neurodegenerative diseases, has been characterized by presence of misfolded proteins, including, but not limited to, tan, amyloid-beta (A beta), alpha-synuclein, HTT (humingtin) or SOD1 (superoxide dismutase 1 protein), and myelin associated inhibitors and their receptors, (see, e.g., Krishnamurday and Sigurdsson, 2011, N Biotechnol. 28(51:511-7, and Musaro, 2013, FEBS J.;280(17):431.5-22, and references therein). Familial ALS has been associated with mutations of TAR DNA-binding protein 43 (TDP-43) and RNA-binding protein FUS/TLS. Some proteins have been identified to slow down progression of ALS, such as, but not limited to, growth factors, e.g. insulin-like growth factor 1 (IGF-1), glial cell line-derived growth factor, brain-derived growth factor, vascular Ofidothelial growth factor and ciliary neurotrophic factor, or growth factors promoting muscle growth, e.g. myostatin.

As of today, there is no prevention or cure for ALS. FDA approved drug niluzole has been approved to prolong the life, but does not have an effect on symptoms. Additionally, drugs and medical devices are available to tolerate pain and attacks associated with ALS. There remains a need for therapy affecting the underlying pathophysiology.

In some embodiment, methods of the present invention may be used to treat subjects suffering from ALS. In some cases, methods of the present invention may be used to treat subjects suspected of developing ALS.

AAV Particles and methods of using the AAV particles described in the present invention may be used to prevent, manage and/or treat MS. As a non-limiting example, the AAV particles of the present invention comprise a nucleic acid sequence encoding at least one of the sequences described in Table 6 (SEQ ID NO: 2948-2970, 3018-3046, 3056-3076, 3110-3130, 3132-3177, 3181-3196, 3242-3268, 3275-3285, 3315-3336, 3338-3371, 3375-3382, 4268-4494).

Stroke

Stroke is a medical emergency characterized by a burst of a blood vessel in the brain, referred to as hemorrhagic stroke, or an interruption of blood supply in the brain, referred to as ischemic stroke. Stroke triggers an inflammation, and causes brain cell death, as the oxygen and nutrient supply is impaired suddenly. Typical symptoms include numbness or weakness, especially on one side of the body, confusion, trouble speaking and understanding speech, vision problems, dizziness and loss of balance. Typically, patients recovering from stroke have permanent disabilities, e.g. affecting movement, speech, coordination, vision and balance. Medical conditions, e.g. diabetes, high blood pressure, high cholesterol, and obesity, as well as, cigarette smoking and poor nutrition, increase susceptibility to a stroke. According to CDC, stroke affects about 800,000 people in the US annually and is the fifth most common cause of death.

Typical recovery from a stroke is slow or impartial. The inability of the central nervous system to repair after injury has been associated with inhibitory proteins associated with CNS. For example, myelin associated proteins, such as, but not limited to, myelin associated glycoprotein (MAG), myelin associated inhibitor (MAI), and their receptors, proteogly cans, versican V2, oligodendrocyte myelin glycoprotein (Omgp), and neurite outgrowth inhibitor (Nogo) have been identified to inhibit neurite outgrowth (see, e.g. Yu et al., 2013, *Transl Stroke Res,* 4(5):477-83, and references therein). Cell death in ischemic stroke has been associated with excessive activation of glutamate receptors, involved with glutamate receptors such as, but not limited to, N-methyl-D-aspartic acid (NMDA) receptors and DL-α-amino-3-hydroxy-5-methyl-4-isoxazole propionic acid (RMPA). Inflammatory signaling triggered after stroke has been associated with adhesion molecules of the endothelial cells, such as, but not limited to, selectin family, intercellular adhesion molecule-1 (ICAM-1, also known as CD54), and β2-integrins.

Therapies to prevent stroke are typically focused on treatment of underlying medical conditions. Acute treatment after stroke involves dissolving blood clot in the case of an ischemic stroke e.g. by antiplatelet agents, anticoagulants and thrombolytics, or quenching of bleeding in the case of a hemorrhagic stroke. As of today, there is no effective prevention therapy for a stroke. There remains a need for therapy affecting the underlying pathophysiology of a stroke. Antibodies targeting the stroke associated proteins have been developed. For example, Refanezumab is a monoclonal antibody targeting myelin-associated glycoprotein, MAO, for improvement and recovery of motor function after stroke.

In some embodiment, methods of the present invention may be used to prevent a stroke, or treat individuals recovering from a stroke.

AAV Particles and methods of using the AAV particles described in the present invention may be used to prevent, manage and/or treat stroke. As a non-limiting example, the AAV particles of the present invention comprise a nucleic acid sequence encoding at least one of the sequences described herein.

Migraine

Migraine is a neurological condition characterized by reoccurring attacks of severe headache, accompanied by nausea, light visions, and sensitivity to light, sound and movement. Migraine attacks may last from hours to days. The cause of migraine is unknown, but it is associated with some underlying diseases, as well as environmental and genetic factors. Migraine affects about 12% of population in the US.

Present methods for management and treatment of migraine include medical therapies (e.g. analgesics, triptans, ergotamines), surgery, and neurostimulation. As of today, there is no therapy to prevent or cure migraine, and a need for medical therapy focusing on the pathophysiology of migraine remains. CGRP (calcitonin gene-related peptide) vasodilatation has been associated with migraine and photophobia, which is a typical symptom of a migraine attach. Antibodies targeting CGRP may be used for treatment and/or management of migraine, e.g. as described in U.S. Pat. Nos. 9,115,194, and 9,102,731, and US Patent application US20120294802, the contents of which are herein incorporated by reference in their entirety.

In some embodiment, methods of the present invention may be used to treat subjects suffering from migraine. In some cases, methods of the present invention may be used to treat subjects suspected of developing migraine.

AAV Particles and methods of using the AAV particles described in the present invention may be used to prevent, manage and/or treat migraine. As a non-limiting example, the AAV particles of the present invention comprise a nucleic acid sequence encoding at least one of the sequences described in Table 10 (SEQ ID NO: 3453-3459, 3856, 3890-3898, 4232-4237, 5220-5239, 6406-6429, 6454-6639, 6955-6956, 7905, 8797-8821, 8842-9026, 9288, 17659-17755).

Pain

Pain is a complex symptom associated with a variety of diseases and disorders and may be acute or chronic. Pain is challenging to treat, and many anti-pain medications have side effects, and/or they can be addictive. There remains a need for pain medications affecting the underlying pathophysiology of a pain. Antibodies for treatment for pain are on the market. For example, fasinumab (developed by Regeneron Pharmaceuticals Inc.), Fulranumab (developed by Johnson & Johnson) and tanezumab (developed by Pfizer) are antibodies against NGF (nerve growth factor) for treatment of pain, such as, osteoarthritis knee pain, chronic low back pain, bone cancer pain and/or pain associated with interstitial cystitis.

in some embodiment, methods of the present invention may be used to treat subjects suffering from pain. In some cases, methods of the present invention may be used to treat subjects suspected of developing pain.

AAV Particles and methods of using the AAV particles described in the present invention may be used to prevent, manage and/or treat pain. As a non-limiting example, the AAV particles of the present invention comprise a nucleic acid sequence encoding at least one of the sequences described in Table 10 (SEQ ID NO: 3453-3459, 3856, 3890-3898, 4232-4237, 5220-5239, 6406-6429, 6454-6639, 6955-6956, 7905, 8797-8821, 8842-9026, 9288, 17659-17755).

Neuropathies

Neuropathies are a group of diseases or conditions affecting the nerves. Typical symptoms of neuropathies include impaired movement and sensation, cramping, pain and abnormal organ functions. Neuropathies include e.g. diabetic neuropathy, cisplatin-induced neuropathy, mononeuropathy, pyridoxine-induced neuropathy, peripheral neuropathy, small fiber peripheral neuropathy, polyneuropathy and cisplatin/pyridoxine-induced neuropathy.

As of today, there is no prevention or treatment therapy specific for neuropathies on the market. Typical treatment involves with treatment of underlying diseases, e.g. diabetes, or management of the symptoms. Therefore, there remains a need for therapy affecting the underlying pathophysiology of neuropathies, such as efficient antibody therapies. Tyrosine kinases, such as Trk receptors, have a role in regulation of the nervous system, neuronal survival and signal cascades. Antibodies targeting e.g. Trk C may be used for prevention, treatment and/or management of neuropathies, as described in U.S. Pat. No. 7,615,383, the contents of which are herein incorporated by reference in their entirety.

In some embodiment, methods of the present invention may be used to treat subjects suffering from neuropathies. In some cases, methods of the present invention may be used to treat subjects suspected of developing neuropathies.

AAV Particles and methods of using the AAV particles described in the present invention may be used to prevent, manage and/or treat neuropathies. As a non-limiting example, the AAV particles of the present invention comprise a nucleic acid sequence encoding at least one of the sequences described in Table 7 (SEQ ID NO: 3040-3046, 3076, 3124-3130, 3164-3177, 3262-3268, 3285, 3329-3336, 3358-3371, 4495-4500).

Psychiatric Disorders

Psychiatric disorders are characterized by behavioral or mental condition that affects individual's ordinary ability to function. Common psychiatric disorders include, but are not limited to, Tourette syndrome, bipolar disorder, schizophrenia, anxiety, depression, panic disorder, obsessive-compulsive disorder (OCD), eating disorders (e.g. anorexia, bulimia, orthorexia, obesity), substance abuse (e.g. alcohol or drug), addiction, psychosis, phobias, mood disorders, manic-depression disorder, insomnia and other sleep disorders. Psychiatric disorders may significantly affect individual's quality of life, and in severe cases lead to harmful behavior, such as suicidal or homicidal behavior. The diseases are typically managed and treated with psychotherapy, behavioral therapy, medical therapy (e.g. antipsychotic drugs), and/or other therapies. There remains a need for improved medical therapies affecting the underlying pathophysiology of psychiatric disorders, such as antibodies targeting proteins associated with such disorders.

For example, ghrelin hormone has been associated with eating disorders, including obesity and anorexia. Antibodies targeting ghrelin may be used for prevention, management and/or treatment of eating disorders, e.g. as described in US Patent application US20060233788 the contents of which are herein incorporated by reference in their entirety.

Depression has been associated with an inhibition of peripheral cytokine activity, especially TNFa (tumor necrosis factor alpha). Antibodies targeting TNT alpha may be used for prevention, management and/or treatment of depression, e.g. as described in US Patent application US20140296493, the contents of which are herein incorporated by reference in their entirety.

OCD and OCD related diseases have been associated T-cell activation. Anx-A1 (annexin A1) is a protein promoting T-cell activation, and antibodies binding Annexin-1 may be used for prevention, management and/or treatment of OCD and related diseases, e.g. as described in US Patent application US20150004164, the contents of which are herein incorporated by reference in their entirety.

In some embodiment, methods of the present invention may be used to treat subjects suffering from a psychiatric disorder. In some cases, methods of the present invention may be used to treat subjects suspected of developing a psychiatric disorder.

AAV Particles and methods of using the AAV particles described in the present invention may be used to prevent, manage and/or treat psychiatric disorder. As a non-limiting example, the AAV particles of the present invention comprise a nucleic acid sequence encoding at least one of the sequences described in Table 8 (SEQ ID NO: 2977-2998, 3152-3177, 3205-3226, 3350-3371 4501-4568).

Cancer

Cancer is a group of more than 100 diseases associated with abnormal division and cell growth with characteristic spreading in the body. Many cancers are in the form of tumors, e.g. breast cancer, lung cancer, colon cancer, ovarian cancer, renal cancer, prostate cancer, head and neck cancer, pancreas cancer, bone cancer, and thyroid cancer. Cancers associated with blood and lymphoid tissues may be referred to as liquid tumors, e.g. leukemia, lymphoma and myeloma. Cancer is caused by failure of tissue growth regulation. Genes associated with cancer include oncogenes, that promote cell growth and reproduction, and tumor suppressor genes, that inhibit cell division. Oncogenes include, but are not limited to, growth factors, receptor and cytoplasmic tyrosine kinases, transcription factors, serine/threonine kinases and regulatory GTPases. Tumor protein p53 is the most common tumor suppressor protein found in more than half ref cancer types. Susceptibility to cancer is involved with environmental factors, as well as genetic. Though progress with prevention, diagnosis and treatment of cancer has been tremendous, cancer still remains a severe and life-threatening disease. According to American Cancer Society, an estimated 1.6 cancers are diagnosed annually in the US, leading to more than a half a million deaths.

Therapies associated with cancer treatment include surgery, chemotherapy, radiation and antibody therapies. Antibodies for treatment and/or prevention of cancers have been on the market for nearly two decades, and are considered as one of the most important strategies for treatment of e.g. hematological malignancies and solid tumors. A number of cancer-associated antigens have been identified for treatment of cancers. Antibodies tameting such antigens may be used to diagnose, prevent and/or treat the associated cancers (see, e.g. Scott et al, 2012, Nature Reviews Cancer 12, 278-287, and references therein).

Some solid cancer tumors are associated with expressed glycoproteins antigens. Such antigens include, but are not limited to, EPCAM (Epithelial cell adhesion molecule), CEA (Carcinoembryonic antigen), gpA33 (Glycoprotein A33 (Transmembrane)), mucins, TAG-72 (Tumor-associated glycoprotein 72), CAIX (Carbonic anhydrase IX), PSMA (Prostate-specific membrane antigen), and FBP (Folate-binding protein). Antibodies targeting the expressed glycoproteins may be used to treat associated tumors. Such solid tumors include, but are not limited to, breast, colon cancer, lung, colorectal, ovarian, renal cell, and/or prostate tumors.

Some solid cancer tumors are associated with growth factor and differentiation signaling associated antigens. Such antigens include, but are not limited to, EGFR/ERBB1/HER1 (epidermal growth factor receptor 1), ERBB2 (epidermal growth factor receptor 2), ERBB3 (piderrral growth factor receptor 3), MET (Tyrosine-Protein Kinase IGF1R (insulin-like growth factor 1 receptor), EPHA3 (EPH Receptor A3), TRAILR1, (Death receptor 4), and (Receptor activator of nuclear factor kappa-B ligand). Cancers that may be treated with antibodies targeting the growth factor and differentiation signaling include, but are not limited to, breast, colon, lung, ovarian, prostate, head and neck, pancreas, thyroid, kidney, and colon tumors, melanoma, glioma, bone metastases, and hematological malignancies.

Some cancer tumors are associated with antigens of stromal and extracellular matrix. Such antigens include, but are not limited to, tenascin and FAP (Fibroblast Activation Protein, Alpha). Cancers that may be treated with antibodies targeting the stromal and extracellular matrix antibodies include, but are not limited to, breast, prostate, colon, lung, pancreas and head and neck tumors and glioma.

Some cancer tumors are associated with such as Lewis-Y Le(y) antigen. Le(y) antigen has been found expressed on a number of cancers, such as, but not limited to, ovarian, breast, colon, lung and prostate cancer. Antibodies targeting Le(y) antigen may be used to treat the associated cancers.

Some cancer tumors are associated with glycolipid antigens. Such antigens include, but are not limited to, gangliosides, such as GD2, GD3, and GM2 (monosialotetrahexosylganglioside 2). Cancers that may be treated with antibodies targeting the glycolipid antigens include, but are not limited to, epithelial tumors (e.g. breast, colon and lung tumors) and neuroectodermal tumors (tumors of the central and peripheral nervous system).

The vasculature of solid tumors is abnormal, compared to normal vasculature. Antigens supporting the formation of abnormal microvasculature and progress of cancer include, but are not limited to, VEGF (Vascular endothelial growth factor), VEGFR (vascular endothelial growth factor receptor), integrin αVβ3 and integrin α5β1. Antibodies targeting such antigens may be used to treat a number of solid tumors such as, but not limited to, lung, breast, renal, brain, eye, colorectal, melanoma, ovarian, and/or other tumors, by preventing the formation of abnormal vasculature.

Hematopoietic and lymphoid malignancies are cancers affecting the blood, bone marrow, lymphs and lymphatic system. Such cancers include e.g. leukemias (acute and chronic lymphoblastic leukemia, acute and chronic myelogenous leukemia), lymphomas (Hodgkin's lymphoma, Non-Hodgkin's lymphoma) and myelomas. Tumors of the hematopoidic and lymphoid tissues are closely related to immune systems. Hematological tumors may be caused by chromosomal abnormalities derived from the myeloid and lymphoid cell lines. The lymphoid cell line produces T and B cells, whereas myeloid cell line produces granulocytes, erythrocytes, thrombocytes, macrophages and mast cells. T and B cell associated hematopoietic differentiation antigens are glycoproteins that are usually from cluster of differentiation (CD) group, such as, but not limited to, CD20, CD30, CD33 and CD52. Antibodies targeting such antigens may be used for prevention and/or treatment hematopoietic and lymphoid cancers.

In some embodiment, methods of the present invention may be used to treat subjects suffering from a cancer. In some cases, methods of the present invention may be used to treat subjects suspected of developing a cancer.

in some embodiments, methods of the present invention may be used for immuno-oncology (I-O) applications. AAV particles or pharmaceutical compsitions of the present invention may be used to develop an immunotherapy or as an immunotherapy in an I-O treatment of a subject suffering from cancer. Non-limiting examples of I-O applications include active, passive or hybrid immunotherapies, checkpoint blockade, adoptive cell transfer (ACT), cancer vaccines, CAR or CAR-T therapies, dendritic cell therapy, stem cell therapies, natural killer (NK) cell-based therapies, and interferon or interleukin based methods.

AAV Particles and methods of using the AAV particles described in the present invention may be used to prevent, manage and/or treat cancer. As a non-limiting example, the AAV particles of the present invention comprise a nucleic acid sequence encoding at least one of the sequences described in Table 9 (SEQ ID NO: 2977-2998, 3031-3039, 3060-3076, 3129-3147, 3181-3196, 3205-3226, 3277-3285, 3335-3345, 3375-3382, 3453-3459, 3856, 3890-3898, 4232-4237, 4308, 4323, 4420, 4431, 4501-4504, 4512-4527, 4535-17658).

Ocular Diseases

Eye is an organ comprising a number of components, including the cornea, aqueous humor, lens, vitreous humor, retina, the retinal pigment epithelium, and choroid. Ocular diseases are conditions affecting the different tissues of the eye. A number of diseases and disorders affect the different components of the eye, and may cause impaired vision, full or partial blindness, irritation, dryness, sensitivity, photophobia, and/or light aversion.

Complement in the eye has an important role in protecting the eye from infections and in modulation of the immune and inflammatory responses. In normal eye, the complement activity is at low level and is regulated by membrane bound and soluble intraocular complement regulatory proteins. Disturbance of the balance between complement activation and complement inhibition may lead to damage to self-tissue (see, e.g, Jha et al., 2007, *Mol Immunol.*; 44(16); 3901-3908, and references therein). The complement system may be activated in three pathways. The classical pathway is activated by immune complexes or substances and involves e.g. complement components C1, C2, C3, C4, C3a, C5, C5a, C51) C6, C7, C8, C9 and C5b-9. The alternative pathway activates complement component C3 when in interaction with e.g. zymosan, or lipopolysaccharide surfaces, additionally involving, e.g. Factor B, Factor Ba, Factor Bb, Factor D, and Factor P. The third activation pathway is the lectin pathway, and is related to interaction of certain serum lectins, e.g. mannose binding lectin (MBL), mannose and N-acetyl glucosamine residues present in bacterial cell walls. Complement activation is associated with a number of ocular diseases, such as, but not related, age-related macular degeneration (AMD), diabetic retinopathy, choroidal neovascularization (CNV), uveitis, diabetic macular edema, pathological myopia, von Hippel-Lindau disease, histoplasmosis of the eye, Central Retinal Vein Occlusion (CRVO), corneal neovascularization, and retinal neovascularization, choroidal neovascularization, and other ocular conditions involving complement activation. Antibodies targeting the associated complement components may be used to diagnose, manage and/or treat such ocular diseases.

Age-related macular degeneration (AMD) is a major cause of irreversible loss of central vision in the elderly worldwide. AMD leads to gradually worsening vision. AMD does not result in blindness, but may affect daily life. Wet AMD is caused by abnormal blood vessels behind the retina grow under the macula and leak blood and fluid that damage the macula. Wet AMD may be treated with laser coagulation and medication to reverse or stop the growth of blood vessels. Dry AMD is caused by break down of the light sensitive cells in the macula. As of today, there is no treatment for dry AMD.

There remains a need for prevention, management and treatment therapies for wet and dry AMD. AMD is associated with complement components, as described above. In addition, AMD is associated with proteins such as, but not limited to, VEGF (Vascular endothelial growth factor), EPO (Erythropoietin), EPOR (EPO receptor), Interleukins IL-1β, IL-17A, Il-10, TNFα (tumor necrosis factor alpha), or FGFR2 (Fibroblast Growth Factor Receptor). Antibodies targeting the AMD associated complement and growth proteins may be used to treat AMD. For example, bevacizumab and ranibizumab (developed by Genentech Inc.) are antibodies targeting VEGF-A to slow down growth of new blood vessels.

Corneal diseases affect the cornea and the conjunctiva. Cornea and conjunctiva form the outer surface of the eye, which is exposed to external environment, and are susceptible to infection agents, trauma, and/or exposure to chemicals, toxins, allergens etc. Cornea is also affected by autoimmune conditions, nutritional deficiencies and cancer. Cortical diseases may cause e.g. loss of vision, blurred vision, tearing, light sensitivity and pain. Diseases affecting cornea include, but are not limited to, keratitis, corneal dystrophy, corneal degeneration, Fuchs' dystrophy, cancer of cornea, and keratoconjunctivitis. Though surgical and medical treatment therapies for corneal diseases exist, in some cases, the diseases still remain severe and may cause blindness. There remains a need to efficient therapies for prevention, management and treatment of corneal diseases. Complement components of the cornea and the conjunctiva present in a normal eye include, but are not limited to, C1, C2, C3, C4, C5, C6, C7, Factor P (properdin) and factor B. Complement may have a role in corneal diseases, and antibodies targeting complement components of the eye may be used for prevention, treatment and/or management of corneal diseases.

Uveitis is an inflammation of the uvea, comprising the iris, choroids, and ciliary body. Early symptoms include eye redness, pain, irritation and blurred vision. Uveitis may lead to transient or permanent loss of vision. Uveitis may be associated with other diseases and conditions, such as infections, systemic diseases, non-infectious and autoimmune diseases. Complement components associated with an autoimmune form of uveitis include C3b and C4b. Uveitis may be managed or treated with vitrectomy, immunosuppressive drugs, corticosteroids or cytotoxic medication. However, despite the existing therapies, autoimmune uveitis is a serious condition and may lead to full or partial blindness. There remains a need for therapies for prevention, management, and treatment of uveitis targeting pathophysiology of the disease.

Retinopathy is a disease resulting from neovascularization. (excessive growth of blood vessels) in the light-sensitive tissue of the eye, retina. Retinopathy may result in impaired vision or partial or full blindness. Retinopathy may be caused by systemic diseases, e.g. diabetes, or hypertension, trauma, excessive sun light exposure or ionizing radiation. Retinopathy is often treated with laser therapy. Medical treatments, such as antibodies, to control the growth of blood vessels, are also applied. However, despite the existing treatment methods, retinopathy is still a severe condition and may lead to blindness. Diabetic retinopathy is one of the leading causes of vision loss in middle-aged individuals. There remains a need for new therapies for prevention, management and/or treatment of retinopathy. For example, antibodies targeting blood vessel growth (e.g. vascular endothelial growth factor (VEGF), complement components (e.g. C3, C4, C1q, C9, C4b), and cluster of differentiation proteins (e.g. CD55, CD59) may be used for prevention, management and/or treatment of different retinopathies.

Photophobia is a condition referring to abnormal sensitivity or aversion to light. Photophobia is related to a number of ocular and nervous system diseases and disorders. Photophobia may be caused by damage to cornea or retina, albinism overstimulation of the photoreceptors, excessive electric pulses to the central nervous system, or optic nerve. Photophobia may be associated with migraine, nervous system disorders (e.g. autism, dyslexia, encephalitis), infections (e.g. rabies, Lyme disease, mononucleosis), eye disorders (e.g. uveitis, corneal diseases, retinal diseases, scarring or trauma to cornea). As of today, there is no medical treatment for photophobia on the market. Photophobia is associated with calcitonin gene related peptide (CORP) and CORP receptors, and antibodies targeting CGRP may be used to prevent and/or treat photophobia, as described in US Patent application US20120294802, the contents of which are herein incorporated by their reference.

In some embodiment, methods of the present invention may be used to treat subjects suffering from ocular diseases. In some cases, methods of the present invention may be used to treat subjects suspected of developing ocular diseases.

AAV Particles and methods of using the AAV particles described in the present invention may be used to prevent, manage and/or treat psychiatric disorder. As a non-limiting example, the AAV particles of the present invention comprise a nucleic acid sequence encoding at least one of the sequences described in Table 11 (SEQ ID NO: 3124-3125, 3164-3177, 3329-3330, 3358-3371, 4308, 4323, 4420, 4431, 4680-4682, 4685-4728, 4735-4772, 4779-4781, 4783, 6792-6919 7022-7024, 7271-7274, 7389-7392, 7396-7439, 7446-7496, 7503-7505, 9142-9255, 9257-9269, 9350, 9466-9468, 9617-9624 9630-9633, 9655-9677, 17666-17670, 17672-17680, 17723-17736, 17756-17875).

Systemic Diseases of the Blood, Heart and Bone

Systemic diseases are a category of conditions affecting the whole body, or many tissues and organs of the body. Systemic conditions associated with the blood, blood vessels, and heart, include, but are not limited to, heart failure, acute coronary syndrome, atherosclerosis, hypertension, lung disease, cardiomyopathy, hypedipidernia, hypercholesterolemia, hypertrigiyceridemia, blood clotting, cardiopulmonary bypass, myocardial infection, platelet aggregation and hemolytic; diseases. In general, such conditions affect individual's quality of life and may be life-threatening. Cardiovascular diseases, referring to heart and blood vessels related conditions, are the leading cause of death worldwide. There remains a need for therapies affecting the pathophysiology of systemic heart, blood and blood circulation diseases. Antibodies for treating such conditions have been developed, targeting proteins such as, but not limited to, selectin P, integrin aIIbβ3, GPIIb/IIIa, RHD (Rh blood group, D antigen), PCSK9 (proprotein convertase subtilisin/kexin type 9), oxLDL (Oxidized low-density lipoprotein), CD20 (B-lymphocyte antigen), ANGPTL3 (Angiopoietin-Like 3). F9 (human factor 9), F10 (human factor 10), TFPI (Tissue Factor Pathway Inhibitor (Lipoprotein-Associated Coagulation Inhibitor)). CD41 (Integrin, Alpha 2b (Platelet Glycoprotein IIb Of IIb/IIIa Complex, Antigen CD41)).

In some embodiment, methods of the present invention may be used to treat subjects suffering from blood, blood circulation and heart related systemic diseases. In some cases, methods of the present invention may be used to treat subjects suspected of developing systemic blood, blood circulation and heart related systemic diseases.

Osteoporosis is a disease characterized by a reduced bone mineral density, and disrupted bone microarchitecture. Individuals with osteoporosis have a high susceptibility to bone fractures. Osteoporosis causes disability especially in the elderly, and may be fatal.

There are medical therapies for management of the osteoporosis, and other conditions associated with reduced bone density, such as calcitonin, bisphosphonates, estrogen replacement and selective estrogen modulators for prevention of bone loss, and anabolic agents to increase bone mass and bone mineral density. However, the present medical therapies have side effects and/or require frequent administration. There remains a need for efficient and long lasting medical therapy affecting the pathophysiology of osteoporosis and other conditions associated with reduced bone density, such as antibody therapies. Antibodies for treatment of osteoporosis are on the market, e.g. blosozuniab (developed by Eli Lilly and Co.) targeting sclerostin (SOST) for increasing bone density, and denosumab (developed by Amgen) targeting TNEST11 (Tumor Necrosis Factor (Ligand) Superfamily, Member 11) for treatment of bone loss.

In some embodiment, methods of the present invention may be used to treat subjects suffering from osteoporosis and/or other conditions associated with reduced bone density. In some cases, methods of the present invention may be used to treat subjects suspected of developing osteoporosis and/or other conditions associated with reduced bone density.

AAV Particles and methods of using the AAV particles described in the present invention may be used to prevent, manage and/or treat systemic diseases of the blood, heart and/or bone. As a non-limiting example, the AAV particles of the present invention comprise a nucleic acid sequence encoding at least one of the sequences described in Table 12 (SEQ ID NO: 7124, 7127, 7291-7293, 9394, 9397, 9485-9487, 17876-17938).

Immune System & Autoimmune Disease

Human immune system is a complex mechanism for identifying and removing harmful environmental agents and repairing the harm and damage caused by them. The basis of the immune system is ability to identify body's own substances from substances acquired. The immune response system can be divided into innate and adaptive systems. The innate system is present at all times and includes macrophages, dendritic cells, myeloid cells (neutrophils, mast cells basophils eosinophils) NK cells, complement factors and cytokines. The adaptive system responses to infectious agents, and include T and B lymphocytes, antibodies and cytokines. Activation of T and B cells in the absence of an infectious agents leads to autoimmune diseases (see, e.g. Mackay et al., 2001 N Engl J Med, Vol. 34.5, No. 5, and references therein). Autoimmune diseases may affect a number of body's tissues and functions, e.g. joints, skin, blood vessels, muscles, organs, intestine etc. Autoimmune diseases arise from and overactive and misguided immune response to body's natural tissues and species. Autoimmune diseases and conditions include, but are not limited to, rheumatoid arthritis, diabetes type 1, systemic lupus erythematosus, celiac sprue, psoriasis, Graves' disease, and Lyme disease. Autoimmune diseases may be caused by infections, drugs, environmental irritants, toxins, and/or genetic factors. Autoimmune diseases affect up to 50 million individuals in the US. Two most common autoimmune diseases are rheumatoid arthritis and autoimmune thyroiditis, together affecting approximately 5% of population in Western countries.

Though medical therapies for autoimmune diseases exits, the diseases may still significantly lower the quality of life, or even be fatal. There remains a need for medical therapies affecting the pathophysiology of autoimmune diseases. Autoimmune disease pathophysiology is associated with a number of factors and may be prevented and/or treated by antibodies targeting associated proteins. Such targets include, but are not limited to, infectious agents; environmental triggers (e.g. gliadin); targets affecting cytokinone production or signaling (e.g. TNFa (tumor necrosis factor alpha), IL-1 (interleukin 1-receptor), 1L-2 (interleukin-2), IL-2R (interleukin-2 receptor), IL-7 (interleukin-7), IL-10 (interleukin-10), IL-10R (interleukin-10 receptor), interferon-y, STAT-3 (Signal transducer and activator of transcription 3), STAT-4 (Signal transducer and activator of transcription 4), TGF beta (transforming growth factor beta), T cell trans TGF beta); T cell regulators (e.g. CTLA4 (Cytotoxic T-Lymphocyte-Associated Protein 4)); complement components (e.g. C1 and C4); TNFa (tumor necrosis factor alpha) and TNFb (tumor necrosis factor beta); T cell regulators (e.g. CD1); epitopes of B and T cells; and/or other targets, such as those associated with B and C cells. (see, e.g. Mackay et al., 2001, N Engl J Med, Vol. 345, No. 5, and references therein).

In some embodiment, methods of the present invention may be used to treat subjects suffering from an autoimmune disease. In some cases, methods of the present invention may be used to treat subjects suspected of developing an autoimmune disease.

AAV Particles and methods of using the AAV particles described in the present invention may be used to prevent, manage and/or treat immune system and autoimmune disease. As a non-limiting example, the AAV particles of the present invention comprise a nucleic acid sequence encoding at least one of the sequences described in Table 9 (SEQ ID NO: 2977-2998, 3031-3039, 3060-3076, 3129-3147, 3181-3196, 3205-3226, 3277-3285, 3335-3345, 3375-3382, 3453-3459, 3856, 3890-3898, 4232-4237, 4308, 4323, 4420, 4431, 4501-4504, 4512-4527, 4535-17658).

Inflammatory Disorders and Inflammation

Inflammation is a natural response of the body to an irritation e.g. by infection, damaged cells or other harmful agents. The purpose of the inflammation is to remove the cause of irritation and necrotic cells and damaged tissues and initiate cell and tissue repair. Inflammation has a role in majority of diseases. Inflammatory disorders are abnormalities in the body's ability to regulate inflammation. Over 100 disorders associated with high level of inflammation have been identified, including, but not limited to, Alzheimer's, ankylosing spondylitis, arthritis (osteoarthritis, rheumatoid arthritis (RA), psoriatic arthritis), asthma, atherosclerosis, Crohn's disease, colitis, dermatitis, diverticulitis, fibromyalgia, hepatitis, irritable bowel syndrome (IBS), systemic lupus erythematous (SLE), nephritis, Parkinson's disease, and ulcerative colitis. Many inflammatory disorders are severe, and even life-threatening. Antibodies targeting proteins associated with inflammation may be used to prevent, manage or treat inflammatory disorders as well as inflammation associated diseases.

A large number of proteins are associated in inflammation, including, but not limited to, TNF (anti-tumor necrosis factor), IL-1R (Interleukin-1 receptor), IL-6R (Interleukin-6 receptor), Alpha integrin subunit, CTLA4 (Cytotoxic T-Lymphocyte-Associated Protein 4), and CD20 (see. e.g. Kotsovilis and Andreakos 2014, Michael Steinitz (ed.), Human Monoclonal Antibodies: Methods and Protocols, *Methods in Molecular Biology*, vol. 1060, and references therein). For example, adalimumab (developed by Abbot Laboratories) is a TNF-targeting antibody for rheumatoid arthritis and other arthritises, psoriasis, and Crohn's disease and Natalizumab (developed by Biogen Idec) is an antibody targeting alpha 4—integring for treatment of Crohn's disease. Additionally, plethora of cytokines, chemokines, adhesion and co-stimulatory molecules, receptors, as well as diverse cell types, may have a role in inflammatoly diseases.

In some embodiment, methods of the present invention may be used to treat subjects suffering from an inflammatory disease. In some cases, methods of the present invention may be used to treat subjects suspected of developing an inflammatory disease.

AAV Particles and methods of using the AAV particles described in the present invention may be used to prevent, manage and/or treat inflammatory disorders and inflammation. As a non-limiting example, the AAV particles of the present invention comprise a nucleic acid sequence encoding at least one of the sequences described in Table 9 (SEQ ID NO: 2977-2998, 3031-3039, 3060-3076, 3129-3147, 3181-3196, 3205-3226, 3277-3285, 3335-3345, 3375-3382, 3453-3459, 3856, 3890-3898, 4232-4237, 4308, 4323, 4420, 4431, 4501-4504, 4512-4527, 4535-1765).

Other Therapeutic Targets

The AAV particles or pharmaceutical compositions of the present invention useful in preventing or treating tatiopathies or tau-associated diseases may alternatively, or in combination, encode an antibody that does not bind to the tau protein (e.g., the antigen is a polypeptide other than tau). Non-limiting examples of other target antigens include any of the following, including fragments or variants thereof, α-synuclein (monomers, oligomers, aggregates, fragments), ABCA1 (ATP-binding cassette, sub-family A, member 1), ABCA4 (ATP-binding cassette, sub-family A, member 4), ABCB1 (ATP-binding cassette, sub-family B, member 1), ACE (angiotensin 1 converting enzyme), ACKR1 (atypical chemokine receptor 1 (Duffy blood group)), AMPA (DL-α- amino-3-hydroxy-5-methyl-4-isoxazole propionic acid), ACTH (Adrenocorticotropic Hormone), ACVR2A (Activin receptor type-2A), ACVR2B (Activin receptor type-2B), ADDL (Adducin-Like Protein 70), ADORA2A (adenosine A2a, receptor), ADRA2A (adrenoceptor alpha 2A), AIFM1 (apoptosis-inducing factor), AKT1 (RAC-alpha serine/threonine-protein kinase), ALK-1 (activin receptor-like kinase 1), Alpha beta fibril, alpha subunit (basic helix-loop-helix transcription factor), AMT (Aminomethyltransferase), Amyloid β (monomers, oligomers, aggregates, fragments), amyloid or amyloid-like proteins, ANGPTL3 (Angiopoietin-Like 3), ANGTF1 (angiopoitin 1), ANGTP2 (angiopoietin 2), ANK3 (ankyrin 3), ANKG (ankyrin G), Annexis IV, phospholipid, Anx-A1 (annexin A1), APOE (apolipoprotein B), APP (amyloid beta precursor protein), ARSD (Arylsulfatase D), ATM (Ataxia Telangiectasia Mutated serine/threonine kinase), ATXN1 (ataxin 1), ATXN2 (ataxin 2), ATXN3 (ataxin 3), ATXN7 (ataxin 7), B Lymphocyte Stimulator, BDNF (brain-derived neurotrophic factor), beta A4 peptide/Alpha beta 4, beta A4 peptide, Alpha beta 5, bAlpha beta 6, Alpha beta 7, Alpha beta 8, Alpha beta 9, Beta-secretases (BACE), BRAT (B-Raf Proto-Oncogene, Serine/Threonine Kinase), Properdin (factor P), Factors Ba and Bb, C1, C1q (complement component 1, subcomponent q), C2, C3, C4, C3a, C3b, C5, C5a, C5b, C6, C7, C8, C9 and C5b-9 (complement components), CAIX (Carbonic anhydrase IX), CA 125 (cancer antigen 125), CACNA1A (calcium channel voltage-dependent P/Q type alpha 1A subunit), cadherins, CA-IX (carbonic anhydrase 9), CALCA (calcitonin-related polypeptide alpha), CCKBR (cholecystokinin B receptor), CCL11 (eotaxin-1), CCL2 (Chemokine (C-C Motif) Ligand 2), CD11 (integrin alpha component), CD147 (basigin), CD154 (CD40L), CD19 (Cluster of Differentiation 19), CD2 (cluster of differentiation 2), CD20 (B-lymphocyte antigen), CD200 (cluster of differentiation 200), CD22 (cluster of differentiation 22), CD221 (insulin-like growth factor 1 (IGF-1) receptor), CD248 (Endosialin), CD26 (Dipeptidyl peptidase-4), CD27 (antigen precursor), CD274 (cluster of differentiation 274), CD28 ('luster of Differentiation 28), CD29 (Integrin, Beta 1), CD3 (cluster of differentiation 3), CD30 (cluster of differentiation 30), CD31 (cluster of differentiation 31), CD33 (duster of differentiation 33), CD37 (Leukocyte antigen), CD38 (cyclic ADP ribose hydrolase), CD3E (T-Cell Surface Antigen T3/Leu-4 Epsilon Chain), CD4 (T-Cell Surface Antigen T4/Leu-3), CD40 (CD40 Molecule, TNF Receptor Superfamily Member 5), CD41 (Integrin, Alpha 2b (Platelet Glycoprotein IIb Of IIb/IIIa Complex, Antigen CD41)), CD44 (cluster of differentiation 44), CD51 (integrin alpha 1), CD52 (Human Epididymis-Specific Protein 5), CD55 (Decay Accelerating Factor For Complement (Cromer Blood Group)), CD58 (lymphocyte function-associated antigen 3), CD59 (MAC-inhibitory protein), CD6 (cluster of differentiation 6), CD 70 (cluster of differentiation 70, ligand for CD27), CD74 (HLA class II histocompatibility antigen gamma chain), CD79B (immunoglobulin-associated beta), CEA (Carcinoembryonic antigen), CFHR1 (Complement Factor H-Related 1), CGRP (Calcitonin gene-related peptide), CHMP2B (charged multivesicular body protein 2B), CHRNA4 (cholinergic receptor nicotinic alpha 4 (neuronal)), CHRNE2 (cholinergic receptor nicotinic beta 2 (neuronal)), CISD2 (CDGSH iron sulfur domain 2), CLEC16A (C-type lectin domain family 16 member A), CLRN1 (clarin 1), CNR1 (cannabinoid receptor 1), CNTNAP2 (contactin associated protein-like 2), COMT (catechol-O-methyltransferase), CRB1 (crumbs family member 1, photoreceptor morphogenesis associated), CRX (cone-rod homeobax), CRY (crystallin), CSFIR (Colony Stimulating Factor 1 Receptor), CSF2 (Colony Stimulating Factor 2 (Granulocyte-Macrophage)), CSF2RA (Colony Stimulating Factor 2 Receptor, Alpha, Low-Affinity), CTGF (Connective Tissue Growth. Factor), CTLA4 (Cytotoxic T-Lymphocyte-Associated Protein 4), CXC (chemokine receptor type 4), CXCL10 (Chemokine (C-X-C Motif) Ligand 10), DDC (dopa decarboxylase (aromatic L-amino acid decarboxylase)), DIABLO (TAP-Binding Mitochondrial Protein), differentiation factor 8 (GDF8), DISC1 (disrupted in schizophrenia 1), DLL3 (Delta-Like 3 (Drosophila)), DLL4 (Delta-Like 4 (Drosophila)), DPP4 (dipeptyl-peptidase 4), DPP6 (dipeptidyl-peptidase 6), DR6 (Death receptor 6), DRD1 (dopamine receptor D1), DRD2 (dopamine receptor D2), DRD4 (dopamine receptor D4), DRD5 (dopamine receptor 5), DRD5 (dopamine receptor D5), DTNBP1 (dystrobrevin binding protein 1), EAG1 (Ether-A-Go-Go Potassium Channel 1), EDB (fibronectin extra domain-B), EDNRA (endothelin receptor type A), EFNA1 (Ephrin-A1), EGFL7 (EGF-Like-Domain, Multiple 7), EGFR/ERBB1/HER 1 (epidermal growth factor receptor 1), EN2 (Engrailed Homeobox 2), EPCAM (Epithelial cell adhesion molecule), EPHA3 (EPH Receptor A3), episialin (a carcinoma-associated mucin, MUC-1), ERBB2 (epidermal growth factor receptor 2), ERBB3 (epidermal growth factor receptor 3), ESR1 (estrogen receptor 1), F3 (coagulation factor III), F9 (human factor 9), F10 (human factor 10), FAAH (fatty acid amide hydrolase), Factor D C3 proactivator convertase), humanized IgG1, humanized IgG2, FAP (Fibroblast Activation Protein, Alpha), FBN2 (fibrillin 2), FBP (Polate-binding protein), FcγRIIB (Fc receptor gamma B), FcγRIIIA (Fc receptor gamma A), FLT1 (Fms-Related Tyrosine Kinase I), FOLR1 (folate receptor alpha), Frizzled receptor, FXN (frataxin), FUS/TLS (RNA binding protein), G protein-coupled, GAA (glucosidase alpha acid), Ge-globulin (Vitamin D binding protein), Gangliosides, GD2 (ganglioside 62), GD3 (ganglioside g3), GM2 (monosialotetrahexosylganglioside 2) (GDF-8 (myostatin), GDNF (glial cell derived neurotrophic factor), GDNF (glial cell derived neurotrophic factor), GFAP (glial fibrillary acidic protein), GFRα3 (GDNF family receptor alpha-3), ghrelin, GIT1 (G protein-coupled receptor kinase interacting ArfGAP 1), GJA (Gap junction protein), GLDC Glycine Dehydrogenase (Decarboxylating), glyeoprotein NMB (GPNMB), gpA33 (Glycoprotein A33 (Transmembrane)), GPC3 (glypican 3), GRIN2B (glutamate receptor ionotropic N-methyl D-aspartate 2B), GRN (granulin), GDF8 (growth differentiation factor 8), GIPases (guanosine triphosphate), GSTF1 (glutathione S-transferase pi 1), GUCA1A (guanylate cyelase activator IA (retina), GUCY2C (anti-GCC), HMCN1 (hemicentin 1), HGF (Hepatocyte Growth Factor), HIF1A (hypoxia inducible factor 1, HINT1 (histidine triad nucleotide binding protein 1), HIST3H3 (Histone H3), histone, HLA-DQB1 (major histocompatibility complex class II DQ beta 1), HLA-DR (MHC class II cell surface receptor), HLA-DRB1 (major histocompatibility complex class II DR beta 1), hNav1.7 (sodium ion channel), HTR1A (5-hydroxy tryptamine (serotonin) receptor 1A G protein-coupled), HTR2A (5-hydroxytryptamine (serotonin) receptor 2A, HTR2A (5-hydroxytryptamine (serotonin) receptor 2A G protein-coupled), HTT (huntingtin), IAP-binding mitochondrial protein, IFNAR1 (Interferon (Alpha, Beta And Omega) Receptor 1), IFNB1 (interferon beta 1 fibroblast), IFN-γ (Interferon gamma), IGF-1 receptor, IGF1R (insulin like growth factor 1 receptor), IGF-1 (insulin-like growth factor 1), IGG1 (inamunoglobulin subclass 1), IgG2 (immunoglobulin subclass 2), IgG4 (immunoglobulin subclass 4), IGHE (Immunoglobulin Heavy Constant Epsilon), IL 1B (interleukin 1 beta), IL12 (interleukin 12), IL12B (interleukin 12B), IL13 (interleukin 13), IL17A (interleukin 17A), IL17F (interleukin 17F)), IL1A (interleukin 1A), IL1B (interleukin 1 beta), IL1-Ri (Interleukin 1 receptor, type I), IL20 (Interleukin 20), IL23A (interleukin 23A), IL-23p19 subunit (interleukin 23 subunit p19), IL2RA (interleukin 2 receptor alpha), IL4R (interleukin 4 receptor alpha, IL6 (interleukin 6), IL6R (interleukin 6 receptor), IL7R (interleukin 7 receptor), ILGF2 (insulin like growth factor 2), INS (insulin), Integrin α5β1, Integrin αVβ3, integin αIIbβ3/GPIIb/IIIa, IP6K2 (inositol hexakisphosphate kinase 2), ITGA4 (Integrin, Alpha 4 (Antigen CD49D, Alpha 4 Subunit Of VLA-4 Receptor)), ITGB7 (Integrin, Alpha 7 (Antigen CD49D, Alpha 4 Subunit Of VLA-7 Receptor)), ITGAL (integrin alpha L chain), ITGAV ((Vitronectin Receptor, Alpha Polypeptide, Antigen CD51), ITGB3 (Integrin alpha-V/beta-3), KCNQ2 (potassium channel voltage gated KQT-like subfamily Q member 2), KDR (Kinase Insert Domain Receptor), KIR2D (killer immunoglobulin-like receptor (KIR) 2D subtype), KLRC1 (Killer Cell Lectin-Like Receptor Subfamily C, Member 1), LAG-3 (Lymphocyte-activation gene 3), Le (y) (Lewis y) antigen, LINGO (Leucine rich repeat and Immunoglobin-like domain-containing protein 1), LOXL2 (Lysyl oxidase homolog 2), LPG (lysophospha-tidylglucoside), LPS (Lipopolysaccharides), LRP1 (low density lipoprotein receptor-related protein 1), LRRC6 (Leucine Rich Repeat Containing 6), LRRK2 (leucine-rich repeat kinase 2), LTA (Lymphotoxin Alpha), MAF (maf avian musculoaponeurotic fibrosarcoma oncogene homolog), MAG (Myelin Associated Glycoprotein), MAI (myelin associated inhibitor), MAOB (monoamine oxidase B), MAPT (microtubule-associated protein tau), MBP (my-elin basic protein), MCAF (monocyte chemotactic and activating factor), MCP-1 (Monocyte chemoattractant protein-1), MBL (mannose binding lectin), mannose, MET (Tyrosine-Protein Kinase Met), MIF (Macrophage Migration Inhibitory Factor (Glycosylation-Inhibiting Factor), MS4A1 (Membrane-Spanning 4-Domains, Subfamily A, Member 1), MSLN (Mesothelin), MST1R (Macrophage Stimulating 1 Receptor), MSTN (myostatin), MUC1/Epi-sialin, MUC5AC (Mucin 5AC, Oligoinexic Mucus/Gel-Formin4 mucin CanAg (glycoform MUC-1), Mucins, myostatin, myostatin antagonists, N-acetyl glucosamine, NCAM1 (Neural Cell Adhesion Molecule 1), Neu5Gc/NGNA (Neurogenin A), neuregulin (NRG), neurokinin B, NGF (Nerve growth factor), NMDA (N-methyl-D-aspartate), NOGO (Neurite outgrowth inhibitor), NOGO receptor-1, Nogo-66, NOGOA/NiG (Neurite Outgrowth Inhibitory Fragments of NOGOA), Notch receptor, NOTCH-1 (Notch homolog 1, translocation-associated (Drosophila)), NRG1 (neuregulin 1), NRP1 (Neuropilin 1), NT-3 trkC ligand, N-terminal region of Aβ8-x peptide, OGG1 (8-oxoguanine DNA glycosylase), oligomers of N-terminal truncated Aβ, OPA2 (Optic Atrophy 2), OPA3 (Optic Atrophy 3), oxLDL (Oxidized low-density lipoprotein), P75 (Low-affinity Nerve Growth Factor Receptor), PAND1 9Panic disorder 1), PAND2 (Panic disorder 2), PAND3 9Panic disorder 3), PARK2 (parkin RBR E3 ubiquitin protein ligase), PCSK9 (proprotein convertase subtilisin/kexin type 9), PD-1 (Programmed cell death protein 1), PD-2 (Programmed cell death protein 2), PD-3 (Programmed cell death protein 3), PD-4 (Programmed cell death protein 4), PD-5 (Programmed cell death protein 5), PD-6 (Programmed cell death protein 6), PD-7 (Programmed cell death protein 7), PD-8 (Programmed cell death protein 8), PDGFRA (Platelet-derived growth factor receptor alpha), PDGFRB (Platelet-derived growth factor receptor beta), PD-L1 (Programmed cell death protein 1 ligand), PEX7 ((Peroxisomal Biogenesis Factor 7), PHOBS (phobia specific), PhosphatidyL-serine, chimeric IgG1, Phosphatide L-serine, Chimeric IgG2, PINK1 (PTEN Induced putative kinase 1), platelet-derived growth factor receptor beta PDGFRB, PLAU (plasminogen activator urokinase), PLP (protelopid protein), PMP22 (peripheral myelin protein 22), POLG (polymerase (DNA directed) gamma), PRDM16 (PR domain containing 16), Prion proteins, PrP, PrPC, PrPSc, PRKCG (protein kinase C gamma), PSEN1 (presenilin 1), PSEN2 (presenilin 2), PSMA (Prostate-specific membrane antigen), PTGS2 (prostaglandin-endoperoxide synthase 2 (prostaglandin G/H synthase and cyclooxygenase)), PTPN11 (Tyrosine-protein phosphatase non-receptor type 11), PVRL4 (Poliovirus Receptor-Related 4), PVRL5 (Poliovirus Receptor-Related 5), pyroglutamated A β, RAf1 (proto-oncogene serine/threonine-protein khaase), RAGE protein, RANKL (Receptor activator of nuclear factor kappa-B ligand), RCAN1 (regulator of calcineurin 1), RDh12 (retinol dehydrogenase 12 (all-trans/9-cis/11-cis)), RGM A (Repulsive guidance molecule A), RHD (Rh blood group, D antigen), RHO (rhodopsin), RPE65 (retinal pigment epithelium-specific protein 65 kDa), RTN4 (Reticulon-4, NOGO), S100B (calcium-binding protein B), SIP4 (Type 4 sphingosine 1-phosphate G protein-coupled receptor), SCN1A (Sodium Channel, Voltage Gated, Type I Alpha Subunit), SDC1 (Syndecan 1), selectin P, SHANK3 (SH3 And Multiple Ankyrin Repeat Domains 3), SLAM7 (SLAM Family Member 7), SLC18A2 (solute carrier family 18 (vesicular monoamine transporter, member 2), SLC1A2 (solute carrier family 1 (glial high affinity glutamate transporter, member 2), SLC34A2 (Solute Carrier Family 34 (Type II Sodium/Phosphate Cotransporter), SLC6A3 (solute carrier family 6 (neurotransmitter transporter) member 3), SLC6A4 (Solute Carrier Family 6 (Neurotransmitter Transporter), SMN1 (survival of motor neuron 1 telomeric), SMN2 (survival of motor neuron 2 centromeric), SNCA (synuclein alpha (non A4 component of amyloid precursor)), SNCA (synuclein alpha (non A4 component of amyloid precursor), SNCB (synuclein beta), SOD1 (superoxide dismutase 1 soluble), SOST (Sclerostin), sphingosine-1-phosphate, SQSTM1 (sequestosome 1), STEAP1 (Six Transmembrane Epithelial Antigen Of The Prostate 1), SULF2 (Sulfatase 2), TACR1 (tachykinin receptor 1), TAG-72 (Tumor-associated glycoprotein 72), TARDBP (TAR DNA binding protein), tau antigen, tau protein, tau pS422, TDP-43, tenascin, tenascin C, TFPI (Tissue Factor Pathway Inhibitor (Lipoprotein-Associated Coagulation Inhibitor)), TGF beta (Transforming growth factor beta), TH (Tyrosine hydroxylase), TkrC (Tropomyosin receptor kinase C), TMEFF2 (Transmembrane Protein With EGF-Like And Two Follistatin-Like Domains 2), TMEFF3 (Transmembrane Protein With EGF-Like And Two Follistatin-Like Domains 3), TNF (tumor necrosis factor), TNFa (tumor necrosis factor alpha), INFRSIF10B (Tumor Necrosis Factor Receptor Superfamily, Member 10b), TNFRSF12A (Tumor Necrosis Factor Receptor Superfamily, Member 12A), TNFRSF8 (Tumor Necrosis Factor Receptor Superfamily, Member 8), TNFRSF9 (Tumor Necrosis Factor Receptor Superfamily, Member 9), INFSF11 (Tumor Necrosis Factor Receptor Superfamily, Member 11), INFSF13B (Tumor Necrosis Factor Receptor Superfamily, Member 13b), TNF-α (Tumor Necrosis Factor alpha)), TNNT2 (troponin T type 2), TOR1A (torsin family 1 member A (tocsin A)), TPBG (Trophoblast Glycoprotein), TPH2 (tryplophan hydroxylase 2), TRAILR1 (Death receptor 4), TRAILR2

(Death receptor 5), TrkA (Tropomyosin receptor kinase A), TRPV4 (Transient Receptor Potential Cation Channel, Subfamily V, Member 4), TSC2 (tuberous sclerosis 2), TULP1 (tubby like protein 1), tumor necrosis factor related protein 5 tumor specific glycosylation of MUC1, tumor-associated calcium signal transducer 2, tumor protein p53, TYRP1 (glycoprotein 75), UCHl1 (ubiquitin carboxyl-terminal esterase L1 (ubiquitin thiolesterase)), UNC-13A (unc-13 homolog A), USH1C (Usher Syndrome 1C), USH2A (Usher Syndrome 2A (Autosomal Recessive, Mild), VEGF (Vascular endothelial growth factor), VEGF A (Vascular endothelial growth factor A), C5, Factor P. Factor D, EPO (Erythropoietin), EPOR (EPO receptor), Interleukins, IL-1β, IL-17A, IL-10, TNFα, FGFR2 (Fibroblast Growth Factor Receptor 2), VEGFR (vascular endothelial growth factor receptor), VEGFR2 (vascular endothelial growth factor receptor 2), vimentin, voltage gated ion channels, VWF (Von Willebrand Factor), WLS1 (Wolfram syndrome 1 (wolframin)), YES1 (Yamaguchi Sarcoma Viral Oncogene Homolog 1).

In one embodiment, the AAV particle of the present invention, useful in treating a non-infectious disease, targets an antigen considered to be useful in the treatment of a different disease. As a non-limiting example, an NAV particle or pharmaceutical composition thereof used for the treatment of cancer, immune system dysfunctions or inflammatory disease may likewise be used for the treatment of a neurodegenerative disorder such as, but not limited to, AD, PD, HD, ALS, SMA, or DLB.

V. Kits and Devices

Kits

In one embodiment, the invention provides a variety of kits for conveniently and/or effectively carrying out methods of the present invention. Typically, kits will comprise sufficient amounts and/or numbers of components to allow a user to perform multiple treatments of a subject(s) and/or to perform multiple experiments.

Any of the AAV particles of the present invention may be comprised in a kit. In some embodiments, kits may further include reagents and/or instructions for creating and/or synthesizing compounds and/or compositions of the present invention. In some embodiments, kits may also include one or more buffers. In some embodiments, kits of the invention may include components for making protein or nucleic acid arrays or libraries and thus, may include, for example, solid supports.

In some embodiments, kit components may be packaged either in aqueous media or in lyophilized form. The container means of the kits will generally include at least one vial, test tube, flask, bottle, syringe or other container means, into which a component may be placed, and preferably, suitably aliquoted. Where there is more than one kit component, (labeling reagent and label may be packaged together), kits may also generally contain second, third or other additional containers into which additional components may be separately placed. In some embodiments, kits may also comprise second container means for containing, sterile, pharmaceutically acceptable buffers and/or other diluents. In some embodiments, various combinations of components may be comprised in one or more vial. Kits of the present invention may also typically include means for containing compounds and/or compositions of the present invention, e.g., proteins, nucleic acids, and any other reagent containers in close confinement for commercial sale. Such containers may include injection or blow-molded plastic containers into which desired vials are retained.

In some embodiments, kit components are provided in one and/or more liquid solutions. In some embodiments, liquid solutions are aqueous solutions, with sterile aqueous solutions being particularly preferred. In some embodiments, kit components may be provided as dried powder(s). When reagents and/or components are provided as dry powders, such powders may be reconstituted by the addition of suitable volumes of solvent. In some embodiments, it is envisioned that solvents may also be provided in another container means. In some embodiments, labeling dyes are provided as dried powders. In some embodiments, it is contemplated that 10, 20, 30, 40, 50, 60, 70, 80, 90, 100, 120, 120, 130, 140, 150, 160, 170, 180, 190, 200, 300, 400, 500, 600, 700, 800, 900, 1000 micrograms or at least or at most those amounts of dried dye are provided in kits of the invention. In such embodiments, dye may then be resuspended in any suitable solvent, such as DMSO.

In some embodiments, kits may include instructions for employing kit components as well the use of any other reagent not included in the kit. Instructions may include variations that may be implemented.

Devices

In one embodiment, the AAV particles may delivered to a subject using a device to deliver the AAV particles and a head fixation assembly. The head fixation assembly may be, but is not limited to, any of the head fixation assemblies sold by MRI interventions. As a non-limiting example, the head fixation assembly may be any of the assemblies described, in U.S. Pat. Nos. 8,099,150, 8,548,569 and 9,031,636 and International Patent Publication Nos. WO201108495 and WO2014014585, the contents of each of which are incorporated by reference in their entireties. A head fixation assembly may be used in combination with an MRI compatible drill such as, but not limited to, the MRI compatible drills described in International Patent Publication No. WO2013181008 and US Patent Publication No. US20130325012, the contents of which are herein incorporated by reference in its entirety.

In one embodiment, the AAV particles may be delivered using a method, system and/or computer program for positioning apparatus to a target point on a subject to deliver the AAV particles. As a non-limiting example, the method, system and/or computer program may be the methods, systems and/or computer programs described in. U.S. Pat. No. 8,340,743, the contents of which are herein incorporated by reference in its entirety. The method may include: determining a target point in the body and a reference point, wherein the target point and the reference point define a planned trajectory line (PTL) extending through each; determining a visualization plane, wherein the PTL intersects the visualization plane at a sighting point; mounting the guide device relative to the body to move with respect to the PTL, wherein the guide device does not intersect the visualization plane; determining a point of intersection (GPP) between the guide axis and the visualization plane; and aligning the GPP with the sighting point in the visualization plane.

In one embodiment, the AAV particles may be delivered to a subject using a convention-enhanced deliver device. Non-limiting examples of targeted delivery of drugs using convection are described in US Patent Publication Nos. US20100217228, US20130035574 and US20130035660 and International Patent Publication No. WO2013019830 and WO2008144585, the contents of each of which are herein incorporated by reference in their entireties.

In one embodiment, a subject may be imaged prior to, during and/or after delivery of the AAV particles. The imaging method may be a method known in the art and/or described herein, such as but not limited to, magnetic resonance imaging (MRI). As a non-limiting example, imaging may be used to assess therapeutic effect. As another non-limiting example, imaging may be used for assisted delivery of AAV particles.

In one embodiment, the AAV particles may be delivered using an MRI-guided device. Non-limiting examples of MRI-guided devices are described in U.S. Pat. Nos. 9,055,884, 9,042,958, 8,886,288, 8,768,433, 8,396,532, 8,369,930, 8,374,677 and 8,175,677 and US Patent Application No. US20140024927 the contents of each of which are herein incorporated by reference in their entireties. As a non-limiting example, the MRI-guided device may be able to provide data in real time such as those described in U.S. Pat. Nos. 8,886,288 and 8,768,433, the contents of each of which is herein incorporated by reference in its entirety. As another non-limiting example, the MRI-guided device or system may be used with a targeting cannula such as the systems described in U.S. Pat. Nos. 8,175,677 and 8,374,677, the contents of each of which are herein incorporated by reference in their entireties. As yet another non-limiting example, the MRI-guided device includes a trajectory guide frame for guiding an interventional device as described, for example, in U.S. Pat. No. 9,055,884 and US Patent Application No. US20140024927, the contents of each of which are herein incorporated by reference in their entireties.

In one embodiment, the AAV particles may be delivered using an MRI-compatible tip assembly. Non-limiting examples of MRI-comparable tip assemblies are described in US Patent Publication No. US20140275980, the contents of which is herein incorporated by reference in its entirety.

In one embodiment, the AAV particles may be delivered using a cannula which is MRI-compatible. Non limiting examples of MRI-compatible catheters include those taught in International Patent Publication No. WO2011130107, the contents of which are herein incorporated by reference in its entirety.

In one embodiment, the AAV particles may be delivered using a catheter which is MRI-compatible. Non-limiting examples of MRI-compatible catheters include those taught in International Patent Publication No. WO2012116265, U.S. Pat. No. 8,825,133 and US Patent Publication No. US20140024909, the contents of each of which are herein incorporated by reference in their entireties.

In one embodiment, the AAV particles may be delivered using a device with an elongated tubular body and a diaphragm as described in US Patent Publication Nos. US20140276582 and US20140276614, the contents of each of which are herein incorporated by reference in their entireties.

In one embodiment, the AAV particles may be delivered using an MRI compatible localization and/or guidance system such as, but not limited to, those described in US Patent Publication Nos. US20150223905 and US20150230871, the contents of each of which are herein incorporated by reference in their entireties. As a non-limiting example, the MRI compatible localization and/or guidance systems may comprise a mount adapted for fixation to a patient, a targeting cannula with a lumen configured to attach to the mount so as to be able to controllably translate in at least three dimensions, and an elongate probe configured to snugly advance via slide and retract in the targeting cannula lumen, the elongate probe comprising at least one of a stimulation or recording electrode.

In one embodiment, the AAV particles may be delivered to a subject using a trajectory frame as described in US Patent Publication Nos. US20150031982 and US20140066750 and International Patent Publication No WO2015057807 and WO2014039481, the contents of each of which are herein incorporated by reference in their entireties.

In one embodiment, the AAV particles may be delivered to a subject using a gene gun.

VI. Definitions

At various places in the present specification, substituents of compounds of the present disclosure are disclosed in groups or in ranges. It is specifically intended that the present disclosure include each and every individual subcombination of the members of such groups and ranges.

About: As used herein, the term "about" means +/−10% of the recited value.

Adeno-associated virus: The term "adeno-associated virus" or "AAV" as used herein refers to members of the dependovirus genus comprising any particle, sequence, gene, protein, or component derived therefrom.

AAV Particle: As used herein, an "AAV particle" is a virus which comprises a viral genome with at least one payload region and at least one ITR region AAV vectors of the present disclosure may be produced recombinantly and may be based on adeno-associated virus (AAV) parent or reference sequences. AAV particle may be derived from any serotype, described herein or known in the art, including combinations of serotypes (i.e., "pseudotyped" AAV) or from various genomes (e.g., single stranded or self complementary). In addition, the AAV particle may be replication defective and/or targeted.

Activity: As used herein, the term "activity" refers to the condition in which things are happening or being done. Compositions of the invention may have activity and this activity may involve one or more biological events.

Administered in combination: As used herein, the term "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial a synergistic) effect is achieved.

Amelioration: As used herein, the term "amelioration" or "ameliorating" refers to a lessening of severity of at least one indicator of a condition or disease. For example, in the context of neurodegeneration disorder, amelioration includes the reduction of neuron loss.

Animal: As used herein, the term "animal" refers to any member of the animal kingdom. In some embodiments, "animal" refers to humans at am' stage of development. In some embodiments, "animal" refers to non-human animals at any stage of development. In certain embodiments, the non-human animal is a mammal (e.g. a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antibody: As used herein, the term "antibody" is referred to in the broadest sense and specifically covers various embodiments including, but not limited to monoclonal antibodies, polyclonal antibodies, multispecific antibodies (e.g. bispecific antibodies formed from at least two intact antibodies), and antibody fragments (e.g., diabodies) so long as they exhibit a desired biological activity (e.g., "functional"). Antibodies are primarily amino-acid based molecules but may also comprise one or more modifications (including, but not limited to the addition of sugar moieties, fluorescent moieties, chemical tags, etc.). Non-limiting examples of antibodies or fragments thereof include $V_H$ and $V_L$ domains, scFvs, Fab, Fab', F(ab')$_2$, Fv fragment, diabodies, linear antibodies, single chain antibody molecules, multispecific antibodies, bispecific antibodies, intrabodies, monoclonal antibodies, polyclonal antibodies, humanized antibodies, codon-optimized antibodies, tandem scFv antibodies, bispecific T-cell enctagers, mAb2 antibodies, chimeric antigen receptors (CAR), tetravalent bispecific antibodies, biosynthetic antibodies, native antibodies, miniaturized antibodies, unibodies, maxibodies, antibodies to senescent cells, antibodies to conformers, antibodies to disease specific epitopes or antibodies to innate defense molecules.

Antibody-based composition: As used herein, "antibody-based" or "antibody-derived" compositions are monomeric or multi-meric polypeptides which comprise at least one amino-acid region derived from a known or parental antibody sequence and at least one amino acid region derived from a non-antibody sequence, e.g., mammalian protein.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may effect the same outcome or a different outcome. The structure that produces the function may be the same or different.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, an AAV particle of the present invention may be considered biologically active if even a portion of the encoded payload is biologically active or mimics an activity considered biologically relevant.

Capsid: As used herein, the term "capsid" refers to the protein shell of a virus particle.

Chimeric antigen receptor (CAR): As used herein, the term "chimeric antigen receptor" or "CAR" refers to an artificial chimeric protein comprising at least one antigen specific targeting region (ASTR), a transmembrane domain and an intracellular signaling domain, wherein the antigen specific targeting region comprises a full-length antibody or a fragment thereof. As a non-limiting example the ASTR of a CAR may be any of the antibodies listed in Tables 3-12, antibody-based compositions or fragments thereof. Any molecule that is capable of binding a target antigen with high affinity can be used in the ASTR of a CAR. The CAR may optionally have an extracellular spacer domain and/or a co-stimulatory domain. A CAR may also be used to generate a cytotoxic cell carrying the CAR.

Complementary and substantially complementary: As used herein, the term "complementary" refers to the ability of polynucleotides to form base pairs with one another. Base pairs are typically formed by hydrogen bonds between nucleotide units in antiparallel polynucleotide strands. Complementary polynucleotide strands can form base pair in the Watson-Crick manner (e.g., A to T, A to U, C to G), or in any other manner that allows for the formation of duplexes. As persons skilled in the art are aware, when using RNA as opposed to DNA, uracil rather than thymine is the base that is considered to be complementary to adenosine. However, when a U is denoted in the context of the present invention, the ability to substitute a T is implied, unless otherwise stated. Perfect complementarity or 100% complementarity refers to the situation in which each nucleotide unit of one polynucleotide strand can form hydrogen bond with a nucleotide unit of a second polynucleotide strand. Less than perfect complementarity refers to the situation in which some, but not all, nucleotide units of two strands can form hydrogen bond with each other. For example, for two 20-mers, if only two base pairs on each strand can form hydrogen bond with each other, the polynucleotide strands exhibit 10% complementarity. In the same example, if 18 base pairs on each strand can form hydrogen bonds Guth each other, the polynucleotide strands exhibit 90% complementarity. As used herein, the term "substantially complementary" means that the siRNA has a sequence (e.g., in the antisense strand) which is sufficient to bind the desired target mRNA, and to trigger the RNA silencing of the target mRNA.

Compound: Compounds of the present disclosure include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

Comprehensive Positional Evolution (CPE™): As used herein, the term "comprehensive positional evolution" refers to an antibody evolution technology that allows for mapping of the effects of amino acid changes at every position along an antibody variable domain's sequence. This comprehensive mutagenesis technology can be used to enhance one or more antibody properties or characteristics.

Comprehensive Protein Synthesis (CPS™): As used herein, the term "comprehensive protein synthesis" refers to a combinatorial protein synthesis technology that can be used to optimize antibody properties or characteristics by combining the best properties into a new, high-performance antibody.

Conditionally active: As used herein, the term "conditionally active" refers to a mutant or variant of a wild-type polypeptide, wherein the mutant or variant is more or less active at physiological conditions than the parent polypeptide. Further, the conditionally active polypeptide may have increased or decreased activity at aberrant conditions as compared to the parent polypeptide. A conditionally active polypeptide may be reversibly or irreversibly inactivated at normal physiological conditions or aberrant conditions.

Conserved: As used herein, the term "conserved" refers to nucleotides or amino acid residues of a polynucleotide sequence or poly peptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some enibodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an polynucleotide or polypeptide or may apply to a portion, region or feature thereof.

Control Elements: As used herein, "control elements", "regulatory control elements" or "regulatory sequences" refers to promoter regions, polyadenylation signals, transcription termination sequences, upstream regulatory domains, origins of replication, internal ribosome entry sites ("IRES"), enhancers, and the like, which provide for the replication, transcription and translation of a coding sequence in a recipient cell. Not all of these control elements need always be present as long as the selected coding sequence is capable of being replicated, transcribed and/or translated in an appropriate host cell.

Controlled Release: As used herein, the term "controlled release" refers to a pharmaceutical composition or compound release profile that conforms to a particular pattern of release to effect a therapeutic outcome.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, priori, or a combination thereof.

Delivery: As used herein, "delivery" refers to the act or manner of delivering an AAV particle, a compound, substance, entity, moiety, cargo or payload.

Delivery Agent: As used herein, "deliver agent" refers to any substance which facilitates, at least in part, the in vivo delivery of an AAV particle to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides or proteins disclosed herein. They may be within the amino acids, the peptides, or proteins, or located at the N- or C-termini.

Digest: As used herein, the term "digest" means to break apart into smaller pieces or components. When referring to poly peptides or proteins, digestion results in the production of peptides.

Distal: As used herein, the term "distal" means situated away from the center or away from a point or region of interest.

Dosing regimen: As used herein, a "dosing regimen" is a schedule of administration or physician determined regimen of treatment, prophylaxis, or palliative care.

Encapsulate: As used herein, the term "encapsulate" means to enclose, surround or encase.

Engineered: As used herein, embodiments of the invention are "engineered" when they are designed to have a feature or property, whether structural or chemical, that varies from a starting point, wild type or native molecule.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

Epitope: As used herein, an "epitope" refers to a surface or region on a molecule that is capable of interacting with a biomolecule. For example, a protein may contain one or more amino acids, an epitope which interacts with an antibody, e.g., a biomolecule. In some embodiments, when referring to a protein or protein module, an epitope may comprise a linear stretch of amino acids or a three-dimensional structure formed by folded amino acid chains.

EvoMap™: As used herein, an EvoMap™ refers to a map of a polypeptide, wherein detailed informatics are presented about the effects of single amino acid mutations within the length of the polypeptide and their influence on the properties and characteristics of that polypeptide.

Expression: As used herein, "expression" of a nucleic acid sequence refers to one or more of the following events: (1)

production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least one AAV particle and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Gene expression: The term "gene expression" refers to the process by which a nucleic acid sequence undergoes successful transcription and in most instances translation to produce a protein or peptide. For clarity, when reference is made to measurement of "gene expression", this should be understood to mean that measurements may be of the nucleic acid product of transcription, e.g., RNA or mRNA or of the amino acid product of translation, e.g., polypeptides or peptides. Methods of measuring the amount or levels of RNA, mRNA, polypeptides and peptides are well known in the art.

Homology: As used herein, the term "homology" refers to the overall relatedness between polymeric molecules, e.g. between polynucleotide molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

Heterologous Region: As used herein the term "heterologous region" refers to a region which would not be considered a homologous region.

Homologous Region: As used herein the term "homologous region" refers to a region which is similar in position, structure, evolution origin, character, form or function.

Identity: As used herein, the term "identity" refers to the overall relatedness between polymeric molecules, e.g., between polynucleotide molecules (e.g. DNA molecules andlor RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 49%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-173, which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1900)).

Inhibit expression gfa gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically, a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that a substance is substantially separated from the environment in which it was formed or detected. Partial separation can include, for example, a composition enriched in the substance or AAV particles of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

Linker: As used herein "linker" refers to a molecule or group of molecules which connects two molecules, such as a $V_H$ chain and $V_L$ chain or an antibody. A linker may be a nucleic acid sequence connecting two nucleic acid sequences encoding two different polypeptides. The linker may or may not be translated. The linker be a cleavable linker.

MicroRNA (miRNA) binding site: As used herein, a microRNA (miRNA) binding site represents a nucleotide location or region of a nucleic acid transcript to which at least the "seed" region of a miRNA binds.

Modified: As used herein "modified" refers to a changed state or structure of a molecule of the invention. Molecules may be modified in many ways including chemically, structurally, and functionally.

Naturally Occurring: As used herein, "naturally occurring" or "wild-type" means existing in nature without artificial aid, or involvement of the hand of man.

Non-human vertebrate: As used herein, a "non-human vertebrate" includes all vertebrates except Homo sapiens, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene, or cellular transcript.

Open reading As used herein, "open reading frame" or "ORF" refers to a sequence which does not contain a stop codon in a given reading frame.

Operably linked: As used herein, the phrase "operably linked" refers to a functional connection between two or more molecules, constructs, transcripts, entities, moieties or the like.

Particle: As used herein, a "particle" is a virus comprised of at least, two components, a protein capsid and a polynucleotide sequence enclosed within the capsid.

Patient: As used herein, "patient" refers to a subject who may seek or be in need of treatment, requires treatment, is receiving treatment, will receive treatment, or a subject who is under care by a trained professional for a particular disease or condition.

Payload: As used herein, "payload" or "payload region" refers to one or more polynucleotides or polynucleotide regions encoded by or within a viral genome or an expression product of such polynucleotide or polynucleotide region, e.g., a transgene, a polynucleotide encoding a polypeptide or multi-polypeptide or a modulatory nucleic acid or regulatory nucleic acid.

Payload construct: As used herein, "payload construct" is one or more polynucleotide regions encoding or comprising a payload that is flanked on one or both sides by an inverted terminal repeat (ITR) sequence. The payload construct is a template that is replicated in a viral production cell to produce a viral genome.

Payload construct vector: As used herein, "payload construct vector" is a vector encoding or comprising a payload construct, and regulatory regions for replication and expression in bacterial cells.

Payload construct expression vector: As used herein, a "payload construct expression vector" is a vector encoding or comprising a payload construct and which further comprises one or more polynucleotide regions encoding or comprising components for viral expression in a viral replication cell.

Peptide: As used herein, "peptide" is less than or equal to 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxy toluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinited starch, propyl paraben, retinylpalmitate, shellac, silicon dioxide, sodium carboxymethyl cellulose, sodium citrate, sodium starch glycolate, sorbitol starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines alkali or organic salts of acidic residues such as carboxylic acids; and the like. Representative acid addition salts include acetate, acetic acid, adipate, alginate, ascorbate, aspartate, berizenesulfonate, berizerie sulfonic acid, benzoate, bisulfate, borate, butyrate, camphorate, camphorsulfonate, citrate, cyclopentanepropionate, digluconate, dodecylsulfate, ethanesuifonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17th ed., Mack Publishing Company, Easton, Pa., 1985, p. 1418, *Pharmaceutical Salts: Properties, Selection, and Use*. P. H. Stahl and C. G. Wermuth (eds.), Wiley-VCH, 2008, and Berge et al., *Journal of Pharmaceutical Science* 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacelamide (DMAC), 1,3-dimethyl-2-imidazolidinone (DMEU), 1,3-dimearyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacokinetic: As used herein, "pharmacokinetic" refers to any one or more properties of a molecule or compound as it relates to the determination of the fate of substances administered to a living organism. Pharmacokinetic is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the In rare cases, some drugs irreversibly accumulate in body tissue.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Proliftrate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Propkylactic: As used herein, "prophylactic" refers to a therapeutic or course of action used to prevent the spread of disease.

Prophylaxis: As used herein, a "prophylaxis" refers to a measure taken to maintain health and prevent the spread of disease.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Purified: As used herein, "purify," "purified." "purification" means to make substantially pure or clear from unwanted components, material defilement, admixture or imperfection. "Purified" refers to the state of being pure. "Purification" refers to the process of making pure.

Region: As used herein, the term "region" refers to a zone or general area. In some embodiments, when referring to a protein or protein module, a region may comprise a linear sequence of amino acids along the protein or protein module or may comprise a three-dimensional area, an epitope and/or a cluster of epitopes. In some embodiments, regions comprise terminal regions. As used herein, the term "terminal region" refers to regions located at the ends or termini of a given agent. When referring to proteins, terminal regions may comprise N- and/or C-termini. N-termini refer to the end of a protein comprising an amino acid with a free amino group. C-termini refer to the end of a protein comprising an amino acid with a free carboxyl group. N- and/or C-terminal regions may there for comprise the N- and/or C-termini as well as surrounding amino acids. In some embodiments, N- and/or C-terminal regions comprise from about 3 amino acid to about 30 amino acids, from about 5 amino acids to about 40 amino acids, from about 10 amino acids to about 50 amino acids, from about 20 amino acids to about 100 amino acids and/or at least 100 amino acids. In some embodiments, N-terminal regions may comprise any length of amino acids that includes the N-terminus, but does not include the C-terminus. In some embodiments, C-terminal regions may comprise any length of amino acids, which include the C-terminus, but do not comprise the N-terminus.

In some embodiments, when referring to a polynucleotide, a region may comprise a linear sequence of nucleic acids along the polynucleotide or may comprise a three-dimensional area, secondary structure, or tertiary structure in some embodiments, regions comprise terminal regions. As used herein, the term "terminal region" refers to regions located at the ends or termini of a given agent. When referring to polynucleotides, terminal regions may comprise 5' and 3' termini. 5' termini refer to the end of a polynucleotide comprising a nucleic acid with a free phosphate group. 3' termini refer to the end of a polynucleotide comprising a nucleic acid with a free hydroxyl group. 5' and 3' regions may there for comprise the 5' and 3' termini as well as surrounding nucleic acids. In some embodiments, 5' and 3' terminal regions comprise from about 9 nucleic acids to about 90 nucleic acids, from about 15 nucleic acids to about 120 nucleic acids, from about 30 nucleic acids to about 150 nucleic acids, from about 60 nucleic acids to about 300 nucleic acids and/or at least 300 nucleic acids. In some embodiments, 5' regions may comprise any length of nucleic acids that includes the 5' terminus, but does not include the 3' terminus. In some embodiments, 3' regions may comprise any length of nucleic acids, which include the 3' terminus, but does not comprise the 5' terminus.

RNA or RNA molecule: As used herein, the term "RNA" or "RNA molecule" or "ribonucleic acid molecule" refers to a polymer of ribonucleotides; the term "DNA" or "DNA molecule" or "deoxyribonucleic acid molecule" refers to a polymer of deoxyribonucleotides. DNA and RNA can be synthesized naturally, e.g., by DNA replication and transcription of DNA, respectively; or be chemically synthesized DNA and RNA can be single-stranded (i.e., ssRNA or ssDNA, respectively) or multi-stranded (e.g., double stranded, i.e., dsRNA and dsDNA, respectively). The term "mRNA" or "messenger RNA", as used herein, refers to a single stranded RNA that encodes the amino acid sequence of one or more polypeptide chains.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Self complementary viral particle: As used herein, a "self-complementary viral particle" is a particle comprised of at least two components, a protein capsid and a polynucleotide sequence encoding a self-complementary genome enclosed within the capsid.

Signal Sequences: As used herein, the phrase "signal sequences" refers to a sequence which can direct the transport or localization of a protein.

Single unit dose: As used herein, a "single unit dose" is a, dose of any therapeutic administered in one dose/at one time/single route/single point of contact, i.e., single administration event. In some embodiments, a single unit dose is provided as a discrete dosage form a tablet, capsule, patch, loaded syringe, vial, etc.).

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Subject. As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or poly peptides or other molecules of the present invention may be chemical or enzymatic.

Targeting: As used herein, "targeting" means the process of design and selection of nucleic acid sequence that will hybridize to a target nucleic acid and induce a desired effect.

Targeted Cells: As used herein, "targeted cells" refers to any one or more cells of interest. The cells may be found in vitro, in viva, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Transfection: As used herein, the term "transfection" refers to methods to introduce exogenous nucleic acids into a cell. Methods of transfection include, but are not limited to, chemical methods, physical treatments and cationic lipids or mixtures.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

Vector: As used herein, a "vector" is any molecule or moiety which transports, transduces or otherwise acts as a carrier of a heterologous molecule. Vectors of the present invention may be produced recombinantly and may be based on and/or may comprise adeno-associated virus (AAV) parent or reference sequence. Such parent or reference AAV sequences may serve as an original, second, third or subsequent sequence for engineering vectors. In non-limiting examples, such parent or reference AAV sequences may comprise any one or more of the following sequences: a polynucleotide sequence encoding a polypeptide or multi-polypeptide, which sequence may be wild-type or modified from wild-type and which sequence may encode full-length or partial sequence of a protein, protein domain, or one or more subunits of a protein a polynucleotide comprising a modulatory or regulatory nucleic acid which sequence may be wild-type or modified from wild-type, and a transgene that may or may not be modified from wild-type sequence. These AAV sequences may sere as either the "donor" sequence of one or more codons (at the nucleic acid level) or amino acids (at the polypeptide level) or "acceptor" sequences of one or more codons (at the nucleic acid level) or amino acids (at the polypeptide level).

Viral genome: As used herein, a "viral genome" or "vector genome" is a polynucleotide comprising at least one inverted terminal repeat (ITR) and at least one encoded payload. A viral genome encodes at least one copy of the payload.

Described herein are compositions, methods, processes, kits and devices for the design, preparation, manufacture and/or formulation of AAV particles. In some embodiments, payloads, such as but not limited to AAV polynucleotides, may be encoded by payload constructs or contained within plasmids or vectors or recombinant adeno-associated viruses (AAVs).

The details of one or more embodiments of the invention are set forth in the accompanying description below. Although any materials and methods similar or equivalent to those described herein can be used in the practice or testing of the present invention, the preferred materials and methods are now described. Other features, of and advantages of the invention will be apparent from the description. In the description, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present description will control.

The present invention is further illustrated by the following non-limiting examples.

VII. Examples

Example 1 Production and Purification of AAV Particles

AAV particles described herein may be produced using methods known in the art, such as, for example, triple transfection or baculovirus mediated virus production. Any suitable permissive or packaging cell known in the art may be employed to produce the vectors. Mammalian cells are often preferred. Also preferred are trans-complementing packaging cell lines that provide functions deleted from a replication-defective helper virus, e.g., 293 cells or other E1a trans-complementing cells.

The gene cassette may contain some or all of the parvovirus (e.g., AAV) cap and rep genes. Preferably, however, some or all of the cap and rep functions are provided in trans by introducing a packaging vector(s) encoding the capsid and/or Rep proteins into the cell. Most preferably, the gene cassette does not encode the capsid or Rep proteins. Alternatively, a packaging cell line is used that is stably transformed to express the cap and/or rep genes Recombinant AAV virus particles are, in some cases, produced and purified from culture supernatants according to the procedure as described in US20160032254, the contents of which are incorporated by reference. Production may also involve methods known in the art including those using 2931 cell, sf9 insect cells, triple transfection or any suitable production method.

In some cases, 293 cells are transfected with CaPO4 with plasmids required for production of AAV, i.e., AAV2 rep, an adenoviral helper construct and a HR flanked transgene cassette. The AAV2 rep plasmid also contains the cap sequence of the particular virus being studied. Twenty-four hours after transfection, which occurs in serum containing DMEM, the medium is replaced with fresh medium with or without serum. Three (3) days after transfection, a sample is taken from the culture medium of the 293 adherent cells. Subsequently cells are scraped and transferred into a receptacle. After centrifugation to remove cellular pellet, a second sample is taken from the supernatant after scraping. Next cell lysis is achieved by three consecutive freeze-thaw cycles (−80 C. to 37 C.). Cellular debris is removed and sample 3 is taken from the medium. The samples are quantified for AAV particles by DNase resistant genome titration by Taqman™ PCR. The total production yield from such a transfection is equal to the particle concentration from sample 3.

AAV vector titers are measured according to genome copy number (genome particles per milliliter). Genome particle concentrations are based on Taqman® PCR of the vector DNA as previously reported (Clark et al. (1999) Hum. Gene Ther., 10:10314039 Veidwijk et al. (2002) Mol. Ther., 6:272-278).

Example 2 Tissue Specific Expression

To evaluate the expression of various encoded antibody payloads in tissues, a series of AAV particles carrying the encoded antibody sequences driven by a panel of ubiquitous and tissue-specific; promoters are made. These particles are administered to the specific tissue, e.g., intramuscularly, via an appropriate route, e.g., a single injection in the gastrocnemius muscle and expression is monitored to determine the relative expression potential of the payload as well as of each promoter in this target tissue. Measurement of antibody production is performed using standard techniques, for example by ELISA.

In some cases, the cytomegalovirus immediate early promoter (CMV), chimeric chicken-beta-actin (CAG), and ubiquitin C (UBC), CBA, H1 promoters provide robust expression.

Example 3 Generation of Antibodies

Antibody Production by Hybridoma Technology

Host animals (e.g. mice, rabbits, goats, and llamas) are immunized by an injection with an antigenic protein to elicit lymphocytes that specifically bind to the antigen. Lymphocytes are collected and fused with immortalized cell lines to generate hybridomas. Hybridomas are cultured in a suitable culture medium that is enriched with appropriate selection agents to promote growth.

Antibodies produced by the cultured hybridomas are subjected to analysis to determine binding specificity of the antibodies for the target antigen. Once antibodies with desirable characteristics are identified, corresponding hybridomas are subcloned through limiting dilution procedures and grown by standard methods. Antibodies produced by these cells are isolated and purified using standard immunoglobulin purification procedures.

Recombinant Antibody Production

Recombinant antibodies are produced using heavy and light chain variable region cDNA sequences selected from hybridomas or from other sources. Sequences encoding antibody variable domains expressed by hybridomas are determined by extracting RNA molecules from antibody-producing hybridoma cells and producing cDNA by reverse transcriptase polymerase chain reaction (PCR). PCR is used to amplify cDNA using primers specific for heavy and light chain sequences. PCR products are then subcloned into plasmids for sequence analysis. Antibodies are produced by insertion of resulting variable domain sequences into expression vectors.

Recombinant antibodies are also produced using phage display technology. Target antigens are screened, in vitro, using phage display libraries having millions to billions of phage particles expressing unique single chain variable fragments (scFvs) on their viral coat. Precipitated phage particles are analyzed and sequences encoding expressed scFvs are determined. Sequences encoding antibody variable domains and/or CDRs are inserted into expression vectors for antibody production.

Recombinant antibodies are further produced using yeast surface display technology, wherein antibody variable domain sequences are expressed on the cell surface of *Saccharomyces cerevisiae*. Recombinant antibodies are developed by displaying the antibody fragment of interest as a fusion to e.g. Aga2p protein on the surface of the yeast, where the protein interacts with proteins and small molecules in a solution. scFvs with affinity towards desired receptors are isolated from the yeast surface using magnetic separation and flow cytometry. Several cycles of yeast surface display and isolation will be done to attain scFvs with desired properties through directed evolution.

Example 4 Optimization of the Encoded Antibody

To design an optimal framework for the expression of an antibody, the heavy and light chains of several antibodies separated by an F2A self-processing peptide sequence are cloned into a mammalian expression vector under the control of the CMV promoter. 293T cells or any suitable cell line transfected with these vectors exhibit secretion of human IgG into the culture supernatant that is then detected by ELISA.

To increase expression, the antibody chains and/or the processing peptide are codon optimized for mammalian expression. In some instances, a furin cleavage site at the N-terminus is inserted for better processing.

To improve secretion of the antibody, the endogenous signal sequences are replaced with a sequence which may or may not be codon optimized, derived from any gene. In some cases, the human growth hormone signal sequence is used. Any of the heavy, light or both chains may be driven by any signal sequence, whether the same or different. Antibody expression is confirmed using standard immunohistochemical techniques, including ELISA.

Example 5 Vectored Antibodies

Viral genomes are designed for AAV delivery of antibodies to cells. The viral genome comprises a payload region and at least one inverted terminal repeat (ITR) region. The payload region may optionally encode regulatory elements a promoter region, an intronic region, or a polyadenylation sequence. The payload region comprises a sequence encoding one or more polypeptides selected from the group consisting of those listed in Table 3. An exemplary payload region comprises a sequence encoding an antibody heavy chain, a region encoding an antibody light chain and a region encoding a linker connecting the heavy and light chain sequences or polypeptides before further processing. A promoter is selected to target the desired tissue or for desired regulation of expression, or both. The promoter may be selected from human EF1α, CMV, CBA, and its derivative CAG, GUSB, UBC, or any other promoter known to one with skill in the art, or combinations thereof. The 5' and 3' ITRs may or may not be of the same serotype as the capsid of the AAV particle.

Payload regions may optionally encode a linker between light and heavy antibody chain sequences or polypeptides. Sequence encoding linkers are derived from an internal ribosome entry site (IRES; SEQ ID NO: 899), foot and mouth disease virus 2A (F2A; SEQ ID NO: 900), porcine teschovirus-1 virus 2A (P2A; SEQ ID NO: 901), a furin cleavage site (F; SEQ ID NO: 902), or a 5xG4S (SEQ ID NO: 903) linker sequence. In various payload regions, the order of heavy and light chains is alternated with respect to 5' to 3' direction. Payloads are further designed to encode protein signal sequences (to aid in protein processing, localization, and/or secretion) as well as an untranslated poly A tail.

Each viral genome is then incorporated into an AAV cloning vector to create payload expression vectors.

The payload expression vectors are expressed in e.g. Expi 293 cells. The supernatants are collected and expressed antibodies are purified using protein A/G beads. Supernatants are diluted with a loading buffer and applied to a column prepared with A/G beads. Unbound proteins are washed through with loading buffer. Elution buffer is added to the column, fractions collected, and fractions containing proteins of interest are identified with absorption spectroscopy technique, pooled together, and neutralized. Western blotting techniques are used to identify payload regions producing the antibody proteins of interest. Purified antibodies are then tested for their affinity to their specific target by e.g. ELISA essay technique and antibodies with the highest affinity are identified and selected.

Finally, the rAAVs are produced using, for example, HEK293T cells. The cells are transfected simultaneously with the viral genome of the present invention, a viral genome encoding helper proteins and a viral genome encoding replication and capsid proteins.

Example 6 In Vivo Expression and Efficacy of Antibody Payloads

To determine the efficacy or comparative expression of encoded antibodies, dose-dependent expression is determined at a series of time points. Samples from mice treated with AAV particles encoding antibodies or luciferase at various levels are examined for expression using standard techniques such as nucleic acid analyses for RNA levels, protein analyses for antibody levels and compared to the expression of the luciferase control.

Example 7 Treatment of Non-Infectious Disease

AAV particles of the current invention encoding an antibody are administered to a patient who has been diagnosed with a non-infectious disease, disorder or condition. The non-infectious disease, disorder or condition may be e.g. a central nervous system disease, muscular disease, neuropathy, psychiatric disorder, ocular disease, pain disorder, migraine, cancer, systemic disease, inflammation, or an immune system disease. The purpose of the treatment may be aimed to manage the disease, prevent or slow the progression of the disease, treat the symptoms associated with the disease and/or cure the disease.

The AAV particles may be administered through an intramuscular injection to the skeletal muscle. The administration may include one or more injections over a period of time. The level and distribution of AAV particles and antibody expression is monitored by standard diagnostic techniques known in the art. Such diagnostic techniques include e.g. (e.g. from blood, urine, or saliva), cerebrospinal fluid (CSF) testing, or any other testing useful for monitoring antibody levels in the body.

Additionally, the progression of the disease and the health of the patient is monitored by standard diagnostic techniques known in the art. Such techniques may include diagnostic imaging (e.g. X-ray, MRA scans, Ultrasound scans, PET scans, Nuclear scans, mammography), biopsy, laboratory tests (e.g. from blood, urine, or saliva), cerebrospinal fluid ((SF) testing, vital signs, clinical tests (cognitive, motor or reflex tests) and other relevant techniques. Treatment with the AAV particles may results in cure of the non-infectious disease, slowing down or stabilizing the progression of the disease, or have no effect on the progression of the disease. Additionally, the treatment may reduce severity of one or more symptoms associated with the disease, eliminate one or more symptoms associated with the disease or have no effect on the symptoms.

VIII. Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient any method of production; any method of use; etc.) can be excluded from any one or more claims for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with reference to the appended claims so as to provide the broadest possible interpretation of such claims in view of the prior art and, therefore, to effectively encompass the intended scope of the invention.

LENGTHY TABLES

The patent contains a lengthy table section. A copy of the table is available in electronic form from the USPTO web site (https://seqdata.uspto.gov/?pageRequest=docDetail&DocID=US11326182B2). An electronic copy of the table will also be available from the USPTO upon request and payment of the fee set forth in 37 CFR 1.19(b)(3).

SEQUENCE LISTING (17941 sequences)

SEQ ID NO: 1 - DNA, 2211 bp, Adeno-associated virus 1
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 2 - protein, 736 aa, Adeno-associated virus 1
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 3 - DNA, 4718 bp, Adeno-associated virus 1
ttgcccactccctctctgcgcgctcgctcgctcggtggggcctgcggaccaaaggtccgcagacggcagagctctgctctgccggccccaccgagcgagcgagcgcgcagagagggagtgggcaactccatcactaggggtaatcgcgaagcgcctcccacgctgccgcgtcagcgctgacgtaaattacgtcataggggagtggtcctgtattagctgtcacgtgagtgcttttgcgacattttgcgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctgggtggccgagaaggaatgggagctgcccccggattctgacatggatctgaatctgattgagcaggcacccctgaccgtggccgagaagctgcagcgcgacttcctggtccaatggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcctgtttgaacctggccgagcgcaaacggctcgtggcgcagcacctgacccacgtcagccagacccaggagcagaacaaggagaatctgaaccccaattctgacgcgcctgtcatccggtcaaaaacctccgcgcgctacatggagctggtcgggtggctggtggaccggggcatcacctccgagaagcagtggatccaggaggaccaggcctcgtacatctccttcaacgccgcttccaactcgcggtcccagatcaaggccgctctggacaatgccggcaagatcatggcgctgaccaaatccgcgcccgactacctggtaggccccgctccgcccgcggacattaaaaccaaccgcatctaccgcatcctggagctgaacggctacgaacctgcctacgccggctccgtctttctcggctgggcccagaaaaggttcgggaagcgcaacaccatctggctgtttgggccggccaccacgggcaagaccaacatcgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggacgagagactgttcagagtgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaattacgtgttaatcaataaaccggttgattcgtttcagttgaactttggtctcctgtccttcttatcttatcggttaccatggttatagcttacacattaactgcttggttgcgcttcgcgataaaagacttacgtcatcgggttacccctagtgatggagttgcccactccctctctgcgcgctcgctcgctcggtggggcctgcggaccaaaggtccgcagacggcagagctctgctctgccggccccaccgagcgagcgagcgcgcagagagggagtgggcaa

SEQ ID NO: 4 - DNA, 3131 bp, Adeno-associated virus
gcggccgcgaattcgcccttggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcggaatttcaacatttgcttcacacacggggtcagagactgctcagagtgtttccccggcgtgtcagaatctcaaccggtcgtcagaaagaggacgtatcggaaactccgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcttacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacctttcaccacgtgactggcagcgactcatcaacaacaactggggattccgacccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgtccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagctagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctataagtgtggactttgctgttaatacagaaggcgtgtactctgaaccccgccccattggcacccgttacctcacccgtaatctgtaattgcctgttaatcaataaaccggttgattcgtttcagttgaactttggtctctgcgaagggcgaattc

SEQ ID NO: 5 - DNA, 255 bp, Adeno-associated virus 10
ggtaattcctccggaaattggcattgcgattccacatggctgggcgacagagtcatcaccaccagcacccgaacctgggtcctgcccacctacaacaaccacatctacaagcaaatctccagcgagacaggagccaccaacgacaaccactacttcggctacagcaccccctgggggtattttgactttaacagattccactgccacttttcaccacgtgactggcagcgactcatcaacaacaactggggattc

SEQ ID NO: 6 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 7 - protein, 738 aa, Adeno-associated virus 10
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 8 - DNA, 258 bp, Adeno-associated virus 11
ggtaattcctccggaaattggcattgcgattccacatggctgggcgacagagtcatcaccaccagcacccgaacctgggccctgccaacctacaacaaccacctctacaaacaaatctccagcgcttcaacgggggccagcaacgacaaccactactttggctacagcaccccctgggggtattttgactttaacagattccactgccacttctcaccacgtgactggcagcgactcatcaacaacaactggggattc

SEQ ID NO: 9 - DNA, 255 bp, Adeno-associated virus 12
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattc

SEQ ID NO: 10 - DNA, 2208 bp, Adeno-associated virus 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 11 - protein, 735 aa, Adeno-associated virus 2 [sequence omitted]

SEQ ID NO: 12 - protein, 621 aa, Adeno-associated virus 2
MPGFYEIVIKVPSDLDGHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 13 - DNA, 4675 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgtacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccggccatggcaagccacaaggacgatgaagaaaagttttttcctcagagcggggttctcatctttgggaagcaaggctcagagaaaacaaatgtgaacattgaaaaggtcatgattacagacgaagaggaaatcggaacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacacggtcagcgtggagatcgagtgggagctgcagaaggaaaacagcaaacgctggaatcccgaaattcagtacacttccaactacaacaagtctgttaatcgtggacttaccgtggatactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 14 - DNA, 4679 bp, Adeno-associated virus 2
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagccgccatgccggggttttacgagattgtgattaaggtccccagcgaccttgacgggcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggcccttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctccggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaattgcttgttaatcaataaaccgtttaattcgtttcagttgaactttggtctctgcgtatttctttcttatctagtttccatggctacgtagataagtagcatggcgggttaatcattaactacaaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 15 - protein, 725 aa, Adeno-associated virus 5
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPTTGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 16 - protein, 644 aa, Artificial Sequence
  Description of Artificial Sequence: Synthetic polypeptide
  MOD_RES (434)..(434): Any amino acid
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNXRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 17 - DNA, 1933 bp, Adeno-associated virus
caaggcctacgaccagcagctcaaagcgggtgacaatccgtacctgcggtataaccacgccgacgccgagtttcaggagtgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggttgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttctccccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacgccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 18 - protein, 644 aa, Artificial Sequence
  Description of Artificial Sequence: Synthetic polypeptide
KAYDQQLKAGDNPYLRYNHADAEFQECLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMVAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFSPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 19 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagccagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacacggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctgggccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgaatgggagctgcagaaagagaacagcaagcgctggaacccagagattcagtacacctccaactttgacaaacagactggagtggactttgctgttgacagccagggtgtttactctgagcct

SEQ ID NO: 20 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSEPVPDPQPIGEPPAGPSGLGSGTMAAGGGAPMADNNEGADGVGNASGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLGRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEP

SEQ ID NO: 21 - DNA, 1933 bp, Adeno-associated virus; identical to SEQ ID NO: 19

SEQ ID NO: 22 - protein, 644 aa, Artificial Sequence; identical to SEQ ID NO: 20
  Description of Artificial Sequence: Synthetic polypeptide

SEQ ID NO: 23 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaatagcgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagcttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 24 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNSEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKLASFITQYSTGQVSVEIEWELQKENSKRWNPEIQYTSNFDKQTGVDFAVDSQGVYSEP

SEQ ID NO: 25 - DNA, 1933 bp, Adeno-associated virus
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggcgtcacaaccatcgctaataaccttaccagcacggttcaggtcttttcggacccggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatggaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagattgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 26 - protein, 644 aa, Artificial Sequence
  Description of Artificial Sequence: Synthetic polypeptide
KAYDQQLKAGDNPYLRYNHADAEFQERLQEDTSFGGNLGRAVFQAKKRVLEPLGLVETPAKTAPGKKRPVDSPDSTSGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDPEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGIVSSNLQAASTAAQTQVVNNQGALPGMVWQNRDVYLQGPIWAKIPHTDGNFHPSPLMGGFGLKHPPPQILIKNTPVPANPPEVFTPAKIASFITQYSTGQVSVEIEWELQKENSKRWNPEIQYTSNFDKQTGVDFAVDSQGVYSEP

SEQ ID NO: 27 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSTTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSARQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKGNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 28 - DNA, 3121 bp, Adeno-associated virus
gaattcgcccttctacggctgcgtcaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcacgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgcgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcgatgtggatttggatgactgcatctttgaacaataaatgatttaaatcaggtatggctgccgatggttatcttccagattggctcgaggacaacctctctgagggcattcgcgagtggtgggcgctgaaacctggagccccgaagcccaaagccaaccagcaaaagcaggacggcggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgactgagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagtaacgcgtctccacgacactgtcgcaaaataacaacagcaactttgtctggaccggtgccaccaagtatcatctgaatggcagagactctctggtagatcccggtgtcgctatggcaacccacaaggacgacgaagagcgattttttccgtccagcggagtcataatgtttgggaaacagggagctggaaaagacaacgtggactatagcagcgtcatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctacctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcaggaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 29 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDGVITTSTRTWALPTYNNHLYKQISNGTSGGSTNDNTYFGYSTPWGYFDFNRFHCHFSPRDWQRLINNNWGFRPKSLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNDNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 30 - DNA, 3121 bp, Adeno-associated virus
gaattcgcccttcgcgagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagcctcccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgtcttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgtcattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggtgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgaggctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactccgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 31 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtga

SEQ ID NO: 32 - protein, 736 aa, Adeno-associated virus 3
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 33 - DNA, 4726 bp, Adeno-associated virus 3
ttggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcgcctgccgggcatttctaactcgtttgttaactgggtggccgagaaggaatgggacgtgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttgaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacgggagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtgaatcctggttaatcaataaaccgtttaattcgtttcagttgaactttggctcttgtgcacttctttatctttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggcctggcgaccaaaggtcgccagacggacgtgctttgcacgtccggccccaccgagcgagcgagtgcgcatagagggagtggccaa

SEQ ID NO: 34 - protein, 737 aa, Artificial Sequence
  Description of Artificial Sequence: Synthetic polypeptide
MAADGYLPDWLEDNLSEGIREWWDLKPGAPKPKANQQKQDNGRGLVLPGYKYLGPFNGLDKGEPVNAADAAALEHDKAYDQQLNAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYEQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSDPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWDPEIQYTSNFEKQTGVDFAVDSQGVYSEPRPIGTRYLTRNL

SEQ ID NO: 35 - DNA, 2211 bp, Adeno-associated virus
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 36 - protein, 736 aa, Adeno-associated virus; identical to SEQ ID NO: 32

SEQ ID NO: 37 - protein, 736 aa, Adeno-associated virus 3A; identical to SEQ ID NO: 32

SEQ ID NO: 38 - protein, 624 aa, Adeno-associated virus 3A
MPGFYEIVLKVPSDLDERLPGISNSFVNWVAEKEWDVPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFEFELTRRLDHDFGKVTKQEVKDFFRWASDHVTDVAHEFYVRKGGAKKRPASNDADVSEPKRECTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 39 - protein, 736 aa, Adeno-associated virus 3B
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 40 - protein, 624 aa, Adeno-associated virus 3B
MPGFYEIVLKVPSDLDEHLPGISNSFVNWVAEKEWELPPDSDMDPNLIEQAPLTVAEKLQREFLVEWRRVSKAPEALFFVQFEKGETYFHLHVLIETIGVKSMVVGRYVSQIKEKLVTRIYRGVEPQLPNWFAVTKTRNGAGGGNKVVDDCYIPNYLLPKTQPELQWAWTNMDQYLSACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGSNPPEDITKNRIYQILELNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIEPTPVIVTSNTNMCAVIDGNSTTFEHQQPLQDRMFKFELTRRLDHDFGKVTKQEVKDFFRWASDHVTDVAHEFYVRKGGAKKRPASNDADVSEPKRQCTSLAQPTTSDAEAPADYADRYQNKCSRHVGMNLMLFPCKTCERMNQISNVCFTHGQRDCGECFPGMSESQPVSVVKKKTYQKLCPIHHILGRAPEIACSACDLANVDLDDCVSEQ

SEQ ID NO: 41 - DNA, 4722 bp, Adeno-associated virus 3B
tggccactccctctatgcgcactcgctcgctcggtggggcctggcgaccaaaggtcgccagacggacgtgctttgcacgtccggccccaccgagcgagcgagtgcgcatagagggagtggccaactccatcactagaggtatggcagtgacgtaacgcgaagcgcgcgaagcgagaccacgcctaccagctgcgtcagcagtcaggtgacccttttgcgacagtttgcgacaccacgtggccgctgagggtatatattctcgagtgagcgaaccaggagctccattttgaccgcgaaatttgaacgagcagcagccatgccggggttctacgagattgtcctgaaggtcccgagtgacctggacgagcacctgccgggcatttctaactcgtttgttaactgggtggccgagaaggaatgggagctgccgccggattctgacatggatccgaatctgattgagcaggcacccctgaccgtggccgaaaagcttcagcgcgagttcctggtggagtggcgccgcgtgagtaaggccccggaggccctcttttttgtccagttcgaaaagggggagacctacttccacctgcacgtgctgattgagaccatcggggtcaaatccatggtggtcggccgctacgtgagccagattaaagagaagctggtgacccgcatctaccgcggggtcgagccgcagcttccgaactggttcgcggtgaccaaaacgcgaaatggcgccgggggcgggaacaaggtggtggacgactgctacatccccaactacctgctccccaagacccagcccgagctccagtgggcgtggactaacatggaccagtatttaagcgcctgtttgaatctcgcggagcgtaaacggctggtggcgcagcatctgacgcacgtgtcgcagacgcaggagcagaacaaagagaatcagaaccccaattctgacgcgccggtcatcaggtcaaaaacctcagccaggtacatggagctggtcgggtggctggtggaccgcgggatcacgtcagaaaagcaatggattcaggaggaccaggcctcgtacatctccttcaacgccgcctccaactcgcggtcccagatcaaggccgcgctggacaatgcctccaagatcatgagcctgacaaagacggctccggactacctggtgggcagcaacccgccggaggacattaccaaaaatcggatctaccaaatcctggagctgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtaaactggaccaatgagaactttcccttcaacgattgcgtcgacaagatggtgatctggtgggaggagggcaagatgacggccaaggtcgtggagagcgccaaggccattctgggcggaagcaaggtgcgcgtggaccaaaagtgcaagtcatcggcccagatcgaacccactcccgtgatcgtcacctccaacaccaacatgtgcgccgtgattgacgggaacagcaccaccttcgagcatcagcagccgctgcaggaccggatgtttaaatttgaacttacccgccgtttggaccatgactttgggaaggtcaccaaacaggaagtaaaggactttttccggtgggcttccgatcacgtgactgacgtggctcatgagttctacgtcagaaagggtggagctaagaaacgccccgcctccaatgacgcggatgtaagcgagccaaaacggcagtgcacgtcacttgcgcagccgacaacgtcagacgcggaagcaccggcggactacgcggacaggtaccaaaacaaatgttctcgtcacgtgggcatgaatctgatgctttttccctgtaaaacatgcgagagaatgaatcaaatttccaatgtctgttttacgcatggtcaaagagactgtggggaatgcttccctggaatgtcagaatctcaacccgtttctgtcgtcaaaaagaagacttatcagaaactgtgtccaattcatcatatcctgggaagggcacccgagattgcctgttcggcctgcgatttggccaatgtggacttggatgactgtgtttctgagcaataaatgacttaaaccaggtatggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaatcctggttaatcaataaaccgtttaattcgtttcagttgaactttggctcttgtgcacttcttatcttatcttgtttccatggctactgcgtagataagcagcggcctgcggcgcttgcgcttcgcggtttacaactgctggttaatatttaactctcgccatacctctagtgatggagttggccactccctctatgcgcactcgctcgctcggtggggccggacgtgcaaagcacgtccgtctggcgacctttggtcgccaggccccaccgagcgagcgagtgcgcatagagggagtggccaa

SEQ ID NO: 42 - DNA, 1800 bp, Adeno-associated virus 4
  modified_base (342)..(342): a, c, t, g, unknown or other
acggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 43 - DNA, 2208 bp, Adeno-associated virus 4
  modified_base (750)..(750): a, c, t, g, unknown or other
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataa

SEQ ID NO: 44 - DNA, 1872 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataa

SEQ ID NO: 45 - DNA, 1611 bp, Adeno-associated virus 4
atgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 46 - DNA, 1872 bp, Adeno-associated virus 4; identical to SEQ ID NO: 44

SEQ ID NO: 47 - DNA, 1617 bp, Adeno-associated virus 4
  modified_base (162)..(162): a, c, t, g, unknown or other
atgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 48 - DNA, 939 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacagattggctagaggacaacctctctga

SEQ ID NO: 49 - DNA, 1197 bp, Adeno-associated virus 4
atggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaa

SEQ ID NO: 50 - DNA, 245 bp, Adeno-associated virus 4
ctccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagc

SEQ ID NO: 51 - protein, 313 aa, Adeno-associated virus 4
  MOD_RES (313)..(313): Any amino acid
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 52 - protein, 399 aa, Adeno-associated virus 4
MELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 53 - protein, 623 aa, Adeno-associated virus 4
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRYQNKCSRHVGMNLMLFPCRQCERMNQNVDICFTHGVMDCAECFPVSESQPVSVVRKRTYQKLCPIHHIMGRAPEVACSACELANVDLDDCDMEQ

SEQ ID NO: 54 - protein, 537 aa, Adeno-associated virus 4
  MOD_RES (537)..(537): Any amino acid
MPGFYEIVLKVPSDLDEHLPGISDSFVSWVAEKEWELPPDSDMDLNLIEQAPLTVAEKLQREFLVEWRRVSKAPEALFFVQFEKGDSYFHLHILVETVGVKSMVVGRYVSQIKEKLVTRIYRGVEPQLPNWFAVTKTRNGAGGGNKVVDDCYIPNYLLPKTQPELQWAWTNMDQYISACLNLAERKRLVAQHLTHVSQTQEQNKENQNPNSDAPVIRSKTSARYMELVGWLVDRGITSEKQWIQEDQASYISFNAASNSRSQIKAALDNASKIMSLTKTAPDYLVGQNPPEDISSNRIYRILEMNGYDPQYAASVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTKRLEHDFGKVTKQEVKDFFRWASDHVTEVTHEFYVRKGGARKRPAPNDADISEPKRACPSVAQPSTSDAEAPVDYADRLARGQPLX

SEQ ID NO: 55 - protein, 623 aa, Adeno-associated virus 4; identical to SEQ ID NO: 53

SEQ ID NO: 56 - protein, 544 aa, Adeno-associated virus 4
MSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 57 - protein, 734 aa, Adeno-associated virus 4
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 58 - protein, 598 aa, Adeno-associated virus 4
TAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 59 - DNA, 129 bp, Adeno-associated virus 4
ttggccactccctctatgcgcgctcgctcactcactcggccctgcggccagaggccggcagtctggagacctttggtgtccagggcagggccgagtgagtgagcgagcgcgcatagagggagtggccaa

SEQ ID NO: 60 - DNA, 125 bp, Adeno-associated virus 4
ttggccactccctctatgcgcgctcgctcactcactcggccctggagaccaaaggtctccagactgccggcctctggccggcagggccgagtgagtgagcgagcgcgcatagagggagtggccaa

SEQ ID NO: 61 - DNA, 4768 bp, Adeno-associated virus 4
  modified_base (3009)..(3009): a, c, t, g, unknown or other
ttggccactccctctatgcgcgctcgctcactcactcggccctggagaccaaaggtctccagactgccggcctctggccggcagggccgagtgagtgagcgagcgcgcatagagggagtggccaactccatcatctaggtttgcccactgacgtcaatgtgacgtcctagggttagggaggtccctgtattagcagtcacgtgagtgtcgtatttcgcggagcgtagcggagcgcataccaagctgccacgtcacagccacgtggtccgtttgcgacagtttgcgacaccatgtggtcaggagggtatataaccgcgagtgagccagcgaggagctccattttgcccgcgaattttgaacgagcagcagccatgccggggttctacgagatcgtgctgaaggtgcccagcgacctggacgagcacctgcccggcatttctgactcttttgtgagctgggtggccgagaaggaatgggagctgccgccggattctgacatggacttgaatctgattgagcaggcacccctgaccgtggccgaaaagctgcaacgcgagttcctggtcgagtggcgccgcgtgagtaaggccccggaggccctcttctttgtccagttcgagaagggggacagctacttccacctgcacatcctggtggagaccgtgggcgtcaaatccatggtggtgggccgctacgtgagccagattaaagagaagctggtgacccgcatctaccgcggggtcgagccgcagcttccgaactggttcgcggtgaccaagacgcgtaatggcgccggaggcgggaacaaggtggtggacgactgctacatccccaactacctgctccccaagacccagcccgagctccagtgggcgtggactaacatggaccagtatataagcgcctgtttgaatctcgcggagcgtaaacggctggtggcgcagcatctgacgcacgtgtcgcagacgcaggagcagaacaaggaaaaccagaaccccaattctgacgcgccggtcatcaggtcaaaaacctccgccaggtacatggagctggtcgggtggctggtggaccgcgggatcacgtcagaaaagcaatggatccaggaggaccaggcgtcctacatctccttcaacgccgcctccaactcgcggtcacaaatcaaggccgcgctggacaatgcctccaaaatcatgagcctgacaaagacggctccggactacctggtgggccagaacccgccggaggacatttccagcaaccgcatctaccgaatcctcgagatgaacgggtacgatccgcagtacgcggcctccgtcttcctgggctgggcgcaaaagaagttcgggaagaggaacaccatctggctctttgggccggccacgacgggtaaaaccaacatcgcggaagccatcgcccacgccgtgcccttctacggctgcgtgaactggaccaatgagaactttccgttcaacgattgcgtcgacaagatggtgatctggtgggaggagggcaagatgacggccaaggtcgtagagagcgccaaggccatcctgggcggaagcaaggtgcgcgtggaccaaaagtgcaagtcatcggcccagatcgacccaactcccgtgatcgtcacctccaacaccaacatgtgcgcggtcatcgacggaaactcgaccaccttcgagcaccaacaaccactccaggaccggatgttcaagttcgagctcaccaagcgcctggagcacgactttggcaaggtcaccaagcaggaagtcaaagactttttccggtgggcgtcagatcacgtgaccgaggtgactcacgagttttacgtcagaaagggtggagctagaaagaggcccgcccccaatgacgcagatataagtgagcccaagcgggcctgtccgtcagttgcgcagccatcgacgtcagacgcggaagctccggtggactacgcggacaggtaccaaaacaaatgttctcgtcacgtgggtatgaatctgatgctttttccctgccggcaatgcgagagaatgaatcagaatgtggacatttgcttcacgcacggggtcatggactgtgccgagtgcttccccgtgtcagaatctcaacccgtgtctgtcgtcagaaagcggacgtatcagaaactgtgtccgattcatcacatcatggggagggcgcccgaggtggcctgctcggcctgcgaactggccaatgtggacttggatgactgtgacatggaacaataaatgactcaaaccagatatgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacaccgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggsggacaaggtgccgatggagtgggtaatgcctcgggtgattggcattgcgattccacctggtctgagggccacgtcacgaccaccagcaccagaacctgggtcttgcccacctacaacaaccacctntacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaataacctgttaatcaataaaccggtttattcgtttcagttgaactttggtctccgtgtccttcttatcttatctcgtttccatggctactgcgtacataagcagcggcctgcggcgcttgcgcttcgcggtttacaactgccggttaatcagtaacttctggcaaaccatgatgatggagttggccactccctctatgcgcgctcgctcactcactcggccctggagaccaaaggtctccagactgccggcctctggccggcagggccgagtgagtgagcgagcgcgcatagagggagtggccaa

SEQ ID NO: 62 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgctgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgaccgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 63 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGETGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 64 - DNA, 2495 bp, Adeno-associated virus
gaattcgccctttctacggctgcgtcaactagaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaccagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaacagtacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtctctgcgaagggcgaattc

SEQ ID NO: 65 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNTSNFAWTGATKYHLNGRNSLTNPGVAMATNKDDEDQFFPINGVLVFGKTGAANKTTLENVLMTSEEEIKTTNPVATEQYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 66 - DNA, 2504 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcatcacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccggctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagccggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 67 - protein, 731 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSSRDWQRLINNNWGFRPKRLNFKLFNIQVKEVTQNEGTKTIANNLTSTIQVFTDSEYRLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKPASFITQYSTGQVSVEIEWELQKENSKRWNPEIQYTSNYYKSTNVDFAVNTEGTYSEPRPIGTRYLTRNL

SEQ ID NO: 68 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctagggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggctaattcgtttcagttgaactttggtctctgcgaagggcgaattc

SEQ ID NO: 69 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 70 - DNA, 3084 bp, Adeno-associated virus
gaattcgccctttctacggctgcatcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagaaaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtccccggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggt

SEQ ID NO: 71 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 72 - DNA, 3123 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgctccagatgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtcggctcaggccaagaactggctacctggaccgtgttaccgtcagcaacgagtttccacgacactgtcgcaaaacaacaacagcaattttgcttggaccggtgccaccaagtatcacctgaatggcagagactccctggttaatcccggcgttgccatggctacccacaaggacgacgaggagcgcttcttcccgtcaagcggagttctaatgtttggcaagcagggggctggaaaagacaatgtggactacagcagcgtgatgctcaccagcgaagaagaaattaaaactactaacccagtggctacagagcagtatggtgtggtggcagacaacctgcagcagaccaacggagctcccattgtgggaactgtcaacagccagggggccttacctggtatggtctggcaaaaccgggacgtgtacctgcagggccccatctgggccaaaattcctcacacggacggcaactttcatccttcgccgctgatgggaggctttggactgaaacacccgcctcctcagatcctggtgaaaaacactcctgttcctgcggatcctccgaccaccttcagccaggccaagctggcttcttttatcacgcagtacagcaccggacaggtcagcgtggaaatcgaatgggagctgcagaaagaaaacagcaagcgctggaacccagagattcagtatacttccaactactacaaatctacaaatgtggactttgctgtcaatactgagggtacttattcagagcctcgccccattggcactcgttatctcacccgtaatctgtaattgcttgttaatcaataaaccggttaattcgtttcagttgaactttggtctctgcgaagggcgaattc

SEQ ID NO: 73 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILVKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 74 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcgccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagactggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcacggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 75 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRLVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFTVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 76 - DNA, 3117 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggagccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcgggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagagcaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 77 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVRVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQSNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 78 - DNA, 3121 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagagttcttccgctgggcgcaggatcacgtgaccgaggtggcgcatgagttccacgtcagaaagggtggcgccaacaagagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcctttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggacttggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgccgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggaaggagtttatagcgagcctcgccccattggcacccgttacctcacccgcaacctgtaattacatgttaatcaataaaccggttaattcgtttcagttgaactttggtctctgcgaagggcgaattc

SEQ ID NO: 79 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDLEYQLPYVLGSAHQGCLPPFPADVFMVPQYGYLTLNNGSQALGRSSFYCLEYFPSQMPRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 80 - DNA, 3122 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgtgtggaccaaaagtgcaagtcttccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacgaagcaggaagtcaaagggttcttccgctgggcgcaggatcacgtgaccgaggtggcgcatgagttccacgtgcgagcccaagcgggcctgcccctcagtcgcggatccatcgacgtcagaccagaaagggtggagccaacaagagacccgcccccgatgacgcggatataagcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatggttcctcagtacggctatttaactttaaacaatggaagccaagccctgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctggtcagaacgcaaacgactggaactggagggacgcagactctggcattcagccaagcgggtcctagctcaatggccaaccaggctagaaattgggtgcccggaccttgctaccggcagcagcgcgtctccacgacaaccaaccagaacaacaacagcaactttgcctggacgggagctgccaagtttaagctgaacggccgagactctctaatgaatccgggcgtggcaatggcttcccacaaggatgacgacgaccgcttcttcccttcgagcggggtcctgatttttggcaagcaaggagccgggaacgatggagtggattacagccaagtgctgattacagatgaggaagaaatcaaggctaccaaccccgtggccacagaagaatatggagcagtggccatcaacaaccaggccgccaatacgcaggcgcagaccggactcgtgcacaaccagggggtgattcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgcttaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaattacatgttaatcaataaaccggttaattcgtttcagttgaactttggtctctgcgaagggcgaattc

SEQ ID NO: 81 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 82 - DNA, 2370 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagttcgaactcacccgccgtctggagcacgactttggcaaggtgaccaagcaggaagtcaaagagttcttccgctgggcgcaggatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgcttcagacgctgtttccctgcaaaacgtgcgagagaatgaatcagaatttcaacatttgcttcacgcacggggtcagagactgctcagaatgtttccccggtgcatcagaatctcaaccggtcgtcagaaaaaaaacgtatcagaaactgtgtgccattcatcatctgctggggcgggcacccgagattgcttgctcggcctgcgatctggtcaacgtggacctggacgactgtgtttctgagcaataaatgacttaaaccaggtatggctgccgatggttatcttccagattggcttgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcacctcagcgttcccccgactcctccacgggcatcggcaagaaaggccaccagcccgcgagaaagagactgaactttgggcagactggcgactcggagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccatctctacaagcaaatctccaacgggacatcgggaggaagcactaacgacaacacctactttggctacagcaccccctgggggtattttgacttcaacagattccactgccacttctcaccacgtgactggcagcgactcatcaacaataactggggattccggcccaagagactcaacttcaagctcttcaacatccaggtcaaggaggtcacgcagaatgaaggcaccaagaccatcgccaataaccttaccagcacgattcaggtgtttacggactcggaataccagctcccgtacgtcctcggctctgcgcaccagggctgcctccctccgttcccggcggacgtcttcatgattcctcagtacgggtatctgaccctaaacaatggcagtcaggctgtgggccgttcctccttctactgcctggaatacttcccttctcaaatgctgaggacgggcaacaactttgaattcagctacaccttcgaggacgtgcctttccacagcagctacgcgcacagccagagcctggaccggctgatgaaccctctcatcgaccagtacctgtattacttatccagaactcagtccacaggaggaactcaaggtactcagcaattgttattttctcaagccgggcccgcaaacatgtyggctcaggccaagaactggctacctggaccgtgttaccgtcagcaacgagtttccacgacactgtcgcaaaacaacaacagcaattttgctggaccggtgccacca

SEQ ID NO: 83 - protein, 738 aa, Artificial Sequence; identical to SEQ ID NO: 73
  Description of Artificial Sequence: Synthetic polypeptide

SEQ ID NO: 84 - DNA, 2205 bp, Adeno-associated virus
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 85 - protein, 734 aa, Adeno-associated virus; identical to SEQ ID NO: 57

SEQ ID NO: 86 - DNA, 3128 bp, Adeno-associated virus
gaattcgccctttctacggctgcgtcaactggaccaatgagaactttcccttcaacgattgcgtcgacaagatgttgatctggtgggaggagggcaagatgacggccaaggtcgtggagtccgccaaggccattctcggcggcagcaaagtgcgcgtggaccaaaagtgcaagccgtccgcccagatcgaccccacccccgtgatcgtcacctccaacaccaacatgtgcgccgtgattgacgggaacagcaccaccttcgagcaccagcagccgttgcgggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactgtaaatcccggtgtcgctatggcaacccacaaggacgacgaagagcgattttgcctggaccggtgccaccaagtatcatctgaatggcagagactctctgttttccgtccagcggagtcttaatgtttgggaaacagggagctggaaaagacaacgtggactatagcagcgttatgctaaccagtgaggaagaaattaaaaccaccaacccagtggccacggaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggacttcgctgttaacacagatggcacttattctgagcctcgccccattggcacccgttacctcacccgtaatctgtaattgctcgttaatcaataaaccggttgattcgtttcagttgaactttggtctctgcgaagggcgaattc

SEQ ID NO: 87 - protein, 738 aa, Artificial Sequence; identical to SEQ ID NO: 7
  Description of Artificial Sequence: Synthetic polypeptide

SEQ ID NO: 88 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggttgtcagaaaaaagacgtatcggaaactctgtgcgattcatcatctgctggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagacccaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccattggcacccgttacctcacccgtaatctgtaattgcttgttaatcaataaaccggttgattcgtttcagttgaactttggtctctgcgaagggcgaattc

SEQ ID NO: 89 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRPNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 90 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 91 - DNA, 2172 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctt

SEQ ID NO: 92 - protein, 720 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYL

SEQ ID NO: 93 - protein, 724 aa, Adeno-associated virus 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 94 - DNA, 2175 bp, Adeno-associated virus 5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 95 - DNA, 2208 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctg

SEQ ID NO: 96 - protein, 736 aa, Adeno-associated virus 6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 97 - protein, 623 aa, Adeno-associated virus 6
MPGFYEIVIKVPSDLDEHLPGISDSFVNWVAEKEWELPPDSDMDLNLIEQAPLTVAEKLQRDFLVQWRRVSKAPEALFFVQFEKGESYFHLHILVETTGVKSMVLGRFLSQIRDKLVQTIYRGIEPTLPNWFAVTKTRNGAGGGNKVVDECYIPNYLLPKTQPELQWAWTNMEEYISACLNLAERKRLVAHDLTHVSQTQEQNKENLNPNSDAPVIRSKTSARYMELVGWLVDRGITSEKQWIQEDQASYISFNAASNSRSQIKAALDNAGKIMALTKSAPDYLVGPAPPADIKTNRIYRILELNGYDPAYAGSVFLGWAQKRFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWAQDHVTEVAHEFYVRKGGANKRPAPDDADKSEPKRACPSVADPSTSDAEGAPVDFADRYQNKCSRHAGMLQMLFPCKTCERMNQNFNICFTHGTRDCSECFPGVSESQPVVRKRTYRKLCAIHHLLGRAPEIACSACDLVNVDLDDCVSEQ

SEQ ID NO: 98 - DNA, 4683 bp, Adeno-associated virus 6
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctggaggggtggagtcgtgacgtgaattacgtcatagggttagggaggtcctgtattagaggtcacgtgagtgttttgcgacattttgcgacaccatgtggtcacgctgggtatttaagcccgagtgagcacgcagggtctccattttgaagcgggaggtttgaacgcgcagcgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgacttcctggtccagtggcgccgcgtgagtaaggccccggaggccctcttctttgttcagttcgagaagggcgagtcctacttccacctccatattctggtggagaccacgggggtcaaatccatggtgctgggccgcttcctgagtcagattagggacaagctggtgcagaccatctaccgcgggatcgagccgaccctgcccaactggttcgcggtgaccaagacgcgtaatggcgccggaggggggaacaaggtggtggacgagtgctacatccccaactacctcctgcccaagactcagcccgagctgcagtgggcgtggactaacatggaggagtatataagcgcgtgtttaaacctggccgagcgcaaacggctcgtggcgcacgacctgacccacgtcagccagacccaggagcagaacaaggagaatctgaaccccaattctgacgcgcctgtcatccggtcaaaaacctccgcacgctacatggagctggtcgggtggctggtggaccggggcatcacctccgagaagcagtggatccaggaggaccaggcctcgtacatctccttcaacgccgcctccaactcgcggtcccagatcaaggccgctctggacaatgccggcaagatcatggcgctgaccaaatccgcgcccgactacctggtaggccccgctccgcccgccgacattaaaaccaaccgcatttaccgcatcctggagctgaacggctacgaccctgcctacgccggctccgtctttctcggctgggcccagaaaaggttcggaaaacgcaacaccatctggctgtttgggccggccaccacgggcaagaccaacatcgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggatctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaattgtgtgttaatcaataaaccggttaattcgtgtcagttgaactttggtctcatgtcgttattatcttatctggtcaccatagcaaccggttacacattaactgcttagttgcgcttcgcgaatacccctagtgatggagttgcccactccctctatgcgcgctcgctcgctcggtggggccggcagagcagagctctgccgtctgcggacctttggtccgcaggccccaccgagcgagcgagcgcgcatagagggagtgggcaa

SEQ ID NO: 99 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 100 - protein, 736 aa, Adeno-associated virus; identical to SEQ ID NO: 96

SEQ ID NO: 101 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 102 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 103 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 104 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaa

SEQ ID NO: 105 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 106 - protein, 737 aa, Adeno-associated virus 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 107 - protein, 623 aa, Artificial Sequence
  Description of Artificial Sequence: Synthetic polypeptide
MPGFYEIVIKVPSDLDEHLPGISDSFVNWVAEKEWELPPDSDMDLNLIEQAPLTVAEKLQRDFLVQWRRVSKAPEALFFVQFEKGESYFHLHVLVETTGVKSMVLGRFLSQIREKLVQTIYRGVEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPADIKTNRIYRILELNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADISEPKRACPSVADPSTSDAEGAPVDFADRYQNKCSRHAGMIQMLFPCKTCERMNQNFNICFTHGVRDCLECFPGVSESQPVVRKKTYRKLCAIHHLLGRAPEIACSACDLVNVDLDDCVSEQ

SEQ ID NO: 108 - DNA, 4721 bp, Adeno-associated virus 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 109 - DNA, 2214 bp, Adeno-associated virus; identical to SEQ ID NO: 104

SEQ ID NO: 110 - protein, 737 aa, Adeno-associated virus; identical to SEQ ID NO: 106

SEQ ID NO: 111 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 112 - DNA, 2213 bp, Adeno-associated virus 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgtaatacagaaggcgtgtactctgaaccccgccccattggcacccgttacctcacccgtaatctg

SEQ ID NO: 113 - DNA, 4393 bp, Adeno-associated virus 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 114 - protein, 738 aa, Adeno-associated virus 8; identical to SEQ ID NO: 105

SEQ ID NO: 115 - protein, 737 aa, Adeno-associated virus 8
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVIQKACTLNPAPLAPVTSPVI

SEQ ID NO: 116 - DNA, 2217 bp, Adeno-associated virus; identical to SEQ ID NO: 111

SEQ ID NO: 117 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcctgagcggacggcgatgagtcttccgggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 118 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLPERTAMSLPGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 119 - DNA, 2214 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgagttttagtcgtgcggttctttgtgatggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctg

SEQ ID NO: 120 - protein, 738 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLSFSRAVLCDGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 121 - DNA, 4385 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacggcaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccaaaggtgtttactctgagcctcgccccattggtactcgttacctcacccgtaatttgtaattgcctgttaatcaataaaccggttaattcgtttcagttgaactttggtctctgcg

SEQ ID NO: 122 - DNA, 4382 bp, Adeno-associated virus 9
cagagagggagtggccaactccatcactaggggtaatcgcgaagcgcctcccacgctgccgcgtcagcgctgacgtagattacgtcataggggagtggtcctgtattagctgtcacgtgagtgcttttgcgacattttgcgacaccacatggccatttgaggtatatatggccgagtgagcgagcaggatctccattttgaccgcgaaatttgaacgagcagcagccatgccgggcttctacgagattgtgatcaaggtgccgagcgacctggacgagcacctgccgggcatttctgactcttttgtgaactgggtggccgagaaggaatgggagctgcccccggattctgacatggatcggaatctgatcgagcaggcacccctgaccgtggccgagaagctgtagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggagaagctggtccagaccatctaccgcgggatcgagccgaccctgcccaactggttcgcggtgaccaagacgcgtaatggcgccggcggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtaggcccttcacttccggtggacattacgcagaaccgcatctaccgcatcctgcagctcaacggctacgaccctgcctacgccggctccgtctttctcggctgggcacaaaagaagttcgggaaacgcaacaccatctggctgtttgggccggccaccacgggaaagaccaacatcgcagaagccattgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccactcccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcagtcaccccaagaaccagactcatcctcgggcatcggcaaatcaggccagcagcccgctaaaaagagactcaattttggtcagactggcgactcagagtcagtccccgacccacaacctctcggagaacctccagaagccccctcaggtctgggacctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggcattgcccacctacaacaaccacctctacaagcaaatctccaatggaacatcgggaggaagcaccaacgacaacacctactttggctacagcaccccctgggggtattttgacttcaacagattccactgccacttctcaccacgtgactggcagcgactcatcaacaacaactggggattccggccaaagagactcaacttcaagctgttcaacatccaggtcaaggaggttacgacgaacgaaggcaccaagaccatcgccaataaccttaccagcaccgtccaggtctttacggactcggagtaccagctaccgtacgtcctaggctctgcccaccaaggatgcctgccaccgtttcctgcagacgtcttcatggttcctcagtacggctacctgacgctcaacaatggaagtcaagcgttaggacgttcttctttctactgtctggaatacttcccttctcagatgctgagaaccggcaacaactttcagttcagctacactttcgaggacgtgcctttccacagcagctacgcacacagccagagtctagatcgactgatgaaccccctcatcgaccagtacctatactacctggtcagaacacagacaactggaactgggggaactcaaactttggcattcagccaagcaggccctagctcaatggccaatcaggctagaaactgggtacccgggccttgctaccgtcagcagcgcgtctccacaaccaccaaccaaaataacaacagcaactttgcgtggacgggagctgctaaattcaagctgaacgggagagactcgctaatgaatcctggcgtggctatggcatcgcacaaagacgacgaggaccgcttctttccatcaagtggcgttctcatatttggcaagcaaggagccgggaacgatggagtcgactacagccaggtgctgattacagatgaggaagaaattaaagccaccaaccctgtagccacagaggaatacggagcagtggccatcaacaaccaggccgctaacacgcaggcgcaaactggacttgtgcataaccagggagttattcctggtatggtctggcagaaccgggacgtgtacctgcagggccctatttgggctaaaatacctcacacagatggcaactttcacccgtctcctctgatgggtggatttggactgaaacacccacctccacagattctaattaaaaatacaccagtgccggcagatcctcctcttaccttcaatcaagccaagctgaactctttcatcacgcagtacagcacgggacaagtcagcgtggaaatcgagtgggagctgcagaaagaaaacagcaagcgctggaatccagagatccagtatacttcaaactactacaaatctacaaatgtggactttgctgtcaataccgaaggtgtttactctgagcctcgccccattggtactcgttacctcacccgtaatttgtaattgcctgttaatcaataaaccggttaattcgtttcagttgaactttggtctctgcg

SEQ ID NO: 123 - protein, 736 aa, Adeno-associated virus 9
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 124 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPEAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 125 - protein, 623 aa, Artificial Sequence
  Description of Artificial Sequence: Synthetic polypeptide
MPGFYEIVIKVPSDLDEHLPGISDSFVNWVAEKEWELPPDSDMDRNLIEQAPLTVAEKLQRDFLVQWRRVSKAPEALFFVQFEKGESYFHLHVLVETTGVKSMVLGRFLSQIREKLVQTIYRGIEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPSLPVDITQNRIYRILQLNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLEHDFGKVTKQEVKEFFRWASDHVTEVAHEFYVRKGGASKRPAPDDADKSEPKRACPSVADPSTSDAEGAPVDFADRYQNKCSRHAGMLQMLLPCKTCERMNQNFNICFTHGVRDCSECFPGVSESQPVVRKRTYRKLCAIHHLLGRAPEIACSACDLVNVDLDDCVSEQ

SEQ ID NO: 126 - DNA, 2211 bp, Adeno-associated virus
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 127 - protein, 736 aa, Adeno-associated virus; identical to SEQ ID NO: 123

SEQ ID NO: 128 - DNA, 2460 bp, Adeno-associated virus
ggtaattcctccggaaattggcattgcgattccacatggctgggcgaccgagtcattaccaccagcacccggacttgggccctgcccacctacaacaaccacctctacaagcaaatctccagccaatcgggtgccaccaacgacaaccactacttcggctacagcaccccttgggggtattttgatttcaacagattccactgccatttctcaccacgtgactggcagcgactcatcaacaacaactggggattcatggctgccgatggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttg

SEQ ID NO: 129 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaggcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccaggccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcgcggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccagtggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccacctgacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataagccgatttatgcgtttcagttgaactttggtctctgcgaagggcgaattcgtttaaacct

SEQ ID NO: 130 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPGPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSAVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPVASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 131 - DNA, 3123 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcgggcaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagaaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcgaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacgataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcaggacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattcgcggccgcta

SEQ ID NO: 132 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGESGQQPAKKRLNFGQTGDTESVPDPQPIGEPPAAPSGVGSNTMASGGGAPMADDNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQDTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 133 - DNA, 3113 bp, Adeno-associated virus
gaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaagtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgttcctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcacctctacaagcaaatctccagcgaatcgggagccaccaacgacaaccactacttcggctacagcaccccctgggggtattttgactttaacagattccactgtcacttctcaccacgtgactggcagcgactcatcaataacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcaaccaagctgggcctagctccatggctcagcaggccaaaaactggctaccgggacccagctaccgacagcagcgaatgtctaagacggctaatgacaacaacaacagtgaatttgcttggactgcagccaccaaatattacccgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacgactaatcctgtggctacagaacaatacggacaggttgccaccaaccgtcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccggaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 134 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFNQAGPSSMAQQAKNWLPGPSYRQQRMSKTANDNNNSEFAWTAATKYYPNGRNSLVNPGPPMASHKDDEEKYFPMHGNLIFGKQGTGTTNVDIESVLITDEEEIRTTNPVATEQYGQVATNRQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 135 - DNA, 3122 bp, Adeno-associated virus
agcggccgcgaattcgccctttctacggctgcgtcaactggaccaatgaaaactttcccttcaacgattgcgtcgacaagatggtgatctggtgggaggagggaaagatgaccgccaaggtcgtggaatctgccaaagccattctgggtggaagcaaggttcgtgtggaccagaaatgcaggtcttcggcccagatcgacccgactccggtgattgtcacctctaacaccaacatgtgcgccgtgattgacggaaactcgaccaccttcgagcaccagcagccgttgcaagaccggatgttcaaatttgaacttacccgccgtttggatcatgactttgggaaggtcaccaagcaggaagtcaaagactttttccggtgggctcaagatcacgtgactgaggtggagcatgagttctacgtcaaaaagggtggagccaagaaaaggcccgcccccgatgatgtatatataaatgagcccaagcgggcgcgcgagtcagttgcgcagccatcgacgtcagacgcggaagcttcgataaactacgcggacaggtaccaaaacaaatgttctcgtcacgtgggcatgaatctgatgctgtttccctgtcgacaatgcgaaagaatgaatcagaattcaaatatctgcttcacacacgggcaaaaagactgtttggaatgctttcccgtgtcagaatctcaacccgtttctgtcgtcagaaaaacgtatcagaaactttgttacattcatcatatcatgggaaaagtaccagacgcctgcactgcctgcgacctggtaaatgtggacttggatgactgtatttctgagcaataaatgacttaaatcaggtatggctgctgacggttatcttccagattggctcgaggacactctctctgaaggaatcagacagtggtggaagctcaaacctggcccaccaccgccgaaacctaaccaacaacaccgggacgacagtaggggtcttgtgcttcctgggtacaagtacctcggacccttcaacggactcgacaaaggagagccggtcaacgaggcagacgccgcggccctcgagcacgacaaagcctacgaccaccagctcaagcaaggggacaacccgtacctcaaatacaaccacgcggacgctgaatttcaggagcgtcttcaagaagatacgtctttcgggggcaacctcgggcgagcagtcttccaggccaaaaagagggtactcgagcctcttggtctggttgaggaagctgttaagacggctcctggaaaaaagagacctatagagcagtctcctgcagaaccggactcttcctcgggcatcggcaaatcaggccagcagcccgctaagaaaagactcaattttggtcagactggcgacacagagtcagtcccagaccctcaaccaatcggagaaccccccgcagccccctctggtgtgggatctaatacaatggcttcaggcggtggggcaccaatggcagacaataacgaaggcgccgacggagtgggtaattcctcgggaaattggcattgcgattccacatggatgggcgacagagttatcaccaccagcacaagaacctgggccctccccacctacaataatcgcctctacaagcaaatctccagcgaatcgggagccaccaacgacaaccactacttcggctacagcaccccctgggggtattttgactttaacagattccactgtcacttctcaccacgtgactggcagcgactcatcaacaacaactggggatttagacccaagaaactcaatttcaagctcttcaacatccaagtcaaggaggtcacgcagaatgatggaaccacgaccatcgccaataaccttaccagcacggtgcaggtcttcacagactctgagtaccagctgccctacgtcctcggttcggctcaccagggctgccttccgccgttcccagcagacgtcttcatgattcctcagtacggctacttgactctgaacaatggcagccaagcggtaggacgttcttcattctactgtctagagtattttccctctcagatgctgaggacgggaaacaacttcaccttcagctacacttttgaagacgtgcctttccacagcagctacgcgcacagccagagtctggatcggctgatgaatcctctcattgaccagtacctgtattacctgagcaaaactcagggtacaagtggaacaacgcagcaatcgagactgcagttcagccaagctgggcctagctccatggctcagcaggccaaaaactggctaccgggacccagctaccgacagcagcgaatgtctaagacggctaatgacaacaacaacagtgaatttgcttggactgcagccaccaaatattacctgaatggaagaaattctctggtcaatcccgggcccccaatggccagtcacaaggacgatgaggaaaagtatttccccatgcacggaaatctcatctttggaaaacaaggcacaggaactaccaatgtggacattgaatcagtgcttattacagacgaagaagaaatcagaacaactaatcctgtggctacagaacaatacggacaggttgccaccaaccatcagagtcagaacaccacagcttcctatggaagtgtggacagccagggaatcttacctggaatggtgtggcaggaccgcgatgtctatcttcaaggtcccatttgggccaaaactcctcacacggacggacactttcatccttctccgctcatgggaggctttggactgaaacaccctcctccccagatcctgatcaaaaacacacctgtgccagcgaatcccgcgaccactttcactcctggaaagtttgcttcgttcattacccagtattccaccggacaggtcagcgtggaaatagagtgggagctgcagaaagaaaacagcaaacgctggaacccagaaattcagtacacctccaactacaacaagtcggtgaatgtggagtttaccgtggacgcaaacggtgtttattctgaaccccgccctattggcactcgttaccttacccggaacttgtaatttcctgttaatgaataaaccgatttatgcgtttcagttgaactttggtctctgcgaagggcgaattc

SEQ ID NO: 136 - protein, 735 aa, Artificial Sequence
  Description of Artificial Sequence: Synthetic polypeptide
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNRLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKTPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 137 - DNA, 3121 bp, Adeno-associated virus
gaattcgcccttcgcagagaccaaagttcaactgaaacgaatcaaccggtttattgattaacaagcaattacagattacgggtgaggtaacgggtgccgatggggcgaggctcagaataagtgccatctgtgttaacagcaaagtccacatttgtagatttgtagtagttggaagtgtattgaatctctgggttccagcgtttgctgttttctttctgcagctcccattcaatttccacgctgacctgtccggtgctgtactgcgtgatgaacgacgccagcttagcttgactgaaggtagttggaggatccgcgggaacaggtgtattcttaatcaggatctgaggaggcgggtgtttcagtccaaagccccccatcagcggcgagggatgaaagtttccgtccgtgtgaggaatcttggcccagataggaccctgcaggtacacgtcccggttctgccagaccatgccaggtaaggctccttgactgttgacggcccctacaataggagcggcgttttgctgttgcaggttatcggccaccacgccgtactgttctgtggccactgggttggtggttttaatttcttcctcactggttagcataacgctgctatagtccacgttgccttttccagctccctgtttcccaaacattaagactccgctggacggaaaaaatcgctcttcgtcgtccttgtgggttgccatagcgacaccgggatttaccagagagtctctgccattcagatgatacttggtggcaccggtccaggcaaagttgctgttgttattttgcgacagtgtcgtggagacgcgttgctgccggtagcagggcccgggtagccagtttttggcctgagccgacatgttattaggcccggcctgagaaaatagcaactgctgagttcctgcggtacctcccgtggactgagtccgagacaggtagtacaggtactggtcgatgagggggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactgaggaatcatgaagacgtccgccgggaacggaggcaggcagccctggcgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgagtctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgaagtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctttcttgccgatgcccgtagtggagtctggagaacgctggggtgatggctctaccggtctcttctttccaggagccgtcttagcgccttcctcaaccagaccgagaggttcgagaacccgcttcttggcctggaagactgctcgtccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggcttcggggctccaggtttcagcgcccaccactcgcgaatgccctcagagaggttgtcctcgagccaatctggaagataaccatcggcagccatacctgatctaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaagggcgaattc

SEQ ID NO: 138 - protein, 733 aa, Artificial Sequence
  Description of Artificial Sequence: Synthetic polypeptide
MAADGYLPDWLEDNLSEGIREWWDLKPGAPKLKANQQKQDDGRGLVLPGYKYLGPFHGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEGEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRRNPEVQFTSNYGNQSSMLWAPDTTGKYTEPRVIGSRYLTNHL

SEQ ID NO: 139 - protein, 735 aa, Adeno-associated virus
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 140 - DNA, 3127 bp, Adeno-associated virus
gcggccgcgaattcgcccttcgcagagaccaaagttcaactgaaacgaatcaaccggtttattgattaacatgcaattacagattacgggtgaggtaacgagtgccaatagggcgaggctcagagtaaacaccctggctgtcaacggcaaagtccacaccagtctgcttttcaaagttggaggtgtactgaatctccgggtcccagcgcttgctgttttccttctgcagctcccactcgatttccacgctgacttgtccggtgctgtactgtgtgatgaacgaagcaaacttggcaggagtaaacacctccggaggattagcgggaacgggagtgttcttgatcaggatctgaggaggcggatgtttaagtccaaagccgcccatcaaaggagacgggtgaaagttgccatccgtgtgaggaatcttggcccagatgggaccctgcaggtacacgtcccggttctgccagaccatgccaggtaaggctccctggttgttgacaacttgtgtctgggctgcagtattagccgcttgtaagttgctgctgactatcccgtattcttccgtggctacaggattagtaggacgaatttcttcttcatttgtcattaacacattttccaatgtagttttgttagttgctccagtttttccaaaaatcaggactccgctggatgggaaaaagcggtcctcgtcgtccttgtgagttgccatggcgacgccgggattaaccaacgagtttctgccgttcaggtgatatttggtggcaccagtccaagcaaagttgctgttgttgttttgatccagcgttttggagaccctttgttgccggaagcagggtccaggtaaccaattcttggcttgttcggccatagttgaaggcccgccctggtaaaactgcagttcccgattgccagctgtgcctcctgggtcactctgtgttctggccaggtagtacaagtactggtcgatgaggggattcatcagccggtccaggctctggctgtgtgcgtagctgctgtggaaaggcacgtcctcgaagctgtagctgaactcaaagttgttgcccgttctcagcatctgagaggggaagtactccaggcagtagaaggaggaacgtcccacagactgactgccattgttgagagtcaggtagccgtactgaggaatcatgaagacgtccgccgggaacggaggcaggcagccctggtgcgcagagccgaggacgtacggcagctggtattccgagtccgagaatacctgaatcgtgctggtaaggttattagcgatggtcgtaacgccgtcattcgtcgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtaggtgttgtcgttggtactacctgcagtttcactggagatttgctcgtagaggtggttgttgtaggtgggcagggcccaggttcgggtgctggtggtaatgactctgtcgcccagccatgtggaatcgcaatgccaatttcctgaggcattacccactccgtcggcaccttcgttattgtctgccattggtgcgccaccgcctgcagccactgtaccagatcccacactagagggcgctgctggaggttctccgagaggttgagggtcggggactgactctgagtcgccagtctgaccgaaattgagtctctttctggcgggctgctggcccttcttgccgatgcccgtggaggagtcgggggaacgctgaggtgacggctctaccggtctcttctttgcaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacgggttgtcacccgcattgagctgctggtcgtaggccttgtcgtgctcgagggccgctgcgtccgccgcgttgacgggctcccccttgtcgagtccgttgaagggtccgaggtacttgtagccaggaagcaccagaccccggccgttgtcctgcttttgctggttggctttgggtttcggggctccaggtttcaggtcccaccactcgcgaatgccctcagagaggttgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggtttagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtaatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcgatcacggcgcacatgttggtgttggagatgacgatcgcgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagccgtagaaagggcgaattc

SEQ ID NO: 141 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLRPFNGLDKGEPVNEADAAALEHDKAYDKQLEQGDNPYLKYNHADAEFQERLQEDTSFGGNLGRAVFQAKKRVLEPLGLVEEVAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFSYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYVHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVCLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 142 - DNA, 3106 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggcacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtctaggctctggctgtgcacatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagctgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgacttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtctgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcactctctcgcatgtcttgcagggaaacagcatctgaagcatgcccgcgtgacgagaacatttgttttggtacctgtcggcaaagtccaccggagctccttccgcgtctgacgtcgatggattcgcgactgaggggcaggcccgcttgggctcgcttttatccgcgtcatcgggggcgggtctcttgttggccccaccctttctgacgtagaacccatgcgccacctcggtcacgtgatcctgcgcccagcggaagaaccttttgacttcctgctttgtcaccttgccaaagttatgctccagacggcgggtgggttcaaatttgaacatccggtcctgcaacggctgctggtgctcgaaggtggcgctgttcccgtcaatcacggcgcacatgttggtgttggaggtgacggtcacgggggtggggtcgatctgggcggacgacttgcacttttggtccacgcgcaccttgctgccgccgagaatggccttggcggactccacgaccttggccgtcatcttgccctcctcccaccagatcaccatcttgtcggcgcaatcgttgaagggaaagttctcattggtccagttgacgcagccgtagaaagggcgaattc

SEQ ID NO: 143 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTASGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFCCLEYFPSQMLRTGNNFEFSYTFEEVPFHSSYAHSQSLDRLMNPLIDQYLYYLARTQSTTGSTRELQFHQAGPNTVAEQSKNWLPGPCYRQQRLSKNIDSNNNSNFAWTGATKYHLNGRNSLTNPGVAMATNKDDEDQFLPINGVLVFGKTGAANKTTLENVLMTSEEEIKTTNPVATEEYGVVSSNLQSSTAGPRTQTVNSQGALPGMVWQNRDVYLQGPIWAEIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 144 - DNA, 3102 bp, Adeno-associated virus
gcggccgcgaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaatttcggcccagatgggaccctgcaggtacacgtcccggttctgccagaccatgccgggcagagccccctggctgttgacagtctgtgtccggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaggaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccacggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagcagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccggaagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaagcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgaagggcgaattc

SEQ ID NO: 145 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 146 - protein, 728 aa, Artificial Sequence
  Description of Artificial Sequence: Synthetic polypeptide
MAADGYLPDWLEGNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 147 - DNA, 3106 bp, Adeno-associated virus
gcggccgcgaattcgcccttcgcagagaccaaagttcaactgaaacgaatcagccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttatcgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggcggctggccgttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacctgtagccaggaagcaccagaccccggccgtcgtcctgcttttgctggttggctttgggtttcggggctccaggtttcaagtcccaccactcgcgaatgccctcagagaggttgccctcgagccaatctggaagataaccatcggcagccatacctggtttaagtcatttattgctcagaaacacagtcatccaggtccacgttggccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcaggggaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatacgccacctcggtcacgtgatcctgcgcccagcggaagaactctttgacttcctgctttgtcaccttgccaaagtcatgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcctgccctcctcccaccagatcaccatcttgtcgacgcaatcgttgaagggaaagttctcattggtccagttgacgcagccgtagaaagggcgaattc

SEQ ID NO: 148 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSMGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEGQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPGVFTPALFASFITQYSTGQVSVEIEWELQKENSKRWNPEIQYTSNYAKSNNVEFAVNNEGVYTEPRPIGTRYLTRNL

SEQ ID NO: 149 - DNA, 3098 bp, Adeno-associated virus
gaattcgcccttcgcagagaccaaagttcaactgaaacgaatcaaccggtttattgattaacaagtaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaactaggcaggagtaaacacccctggaggattagcaggtaccggggtgtttttgatgagaatttgaggaggcgggtgtttgagtccaaatccgcccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggccctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctgtgcgcatagctgctgtggaaaggcacttcctcaaaggtgtagctgaattcaaagttattgcccgttctcagcatctgagaaggaaagtactccaggcagtagaaggaggaacgtcccatagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgttcgtcgtgacctccttgacctggatgttgaacaacttgaaccgcagctttctgggccggaatccccagttgttgttgatgagtcgctgccagtcacgtggtgagaagtggcagtggaatctgttgaagtcaaaatagccccagggggtgctgtagccgaagaagtggttgtcgttggtagccccgctctgacttgatatctgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgggggtcgggcactgactctgagtcgccagtctgcccaaagttgagcttctttttagcgggctgctggcctttcttgccgatgcccgtggaggagtcgggggattctatgggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcagcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggcctcttgttggctccaccctttctgacgtagaactcatgcgccacctcggtcacgtgatcctgcgcccagcggaagaactctttgacttcctgctttgtcaccttgccaaagtcctgctccagacggcgggtgagttcaaatttgaacatccggtcttgtaacggctgctggtgctcgaaggtggtgctgttcccgtcaatcacggcgcacatgttggtgttggaagtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 150 - DNA, 2187 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 151 - protein, 728 aa, Adeno-associated virus; identical to SEQ ID NO: 146

SEQ ID NO: 152 - protein, 728 aa, Adeno-associated virus
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGDNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 153 - protein, 728 aa, Adeno-associated virus; identical to SEQ ID NO: 145

SEQ ID NO: 154 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 155 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 156 - DNA, 2215 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcactctcctgtggagccagactcctcctcgggaaccggaaaggcgggccagcagcctgcaagaaaaagattgaattttggtcagactggagacgcagactcagtcccagaccctcaaccaatcggagaacctcccgcagccccctcaggtgtgggatctcttacaatggctgcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaagcaaatctccaacagcacatctggaggatcttcaaatgacaacgcctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagtttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacctgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 157 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 158 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLKTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 159 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEHSPVEPDSSSGTGKAGQQPARKRLNFGQTGDADSVPDPQPIGEPPAAPSGVGSLTMAAGGGAPMADNNEGADGVGNSSGNWHCDSTWMGDRVITTSTRTWALPTYNNHLYKQISNSTSGGSSNDNAYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQQGNTQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 160 - protein, 729 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 161 - DNA, 3075 bp, Adeno-associated virus
tgagaactttcctttcaacgattgcgtcggacaagatggtgatctggtgggaggaggggaagatgaccgccaaggtcgtggagtcggccaaagccattcttggaggaagcaaggtgcgtgtggaccagaaatgcaagtcctcggcccagatagacccgactcccgtgatcgtcacctccaacaccaacatgtgcgccgtgattgacgggaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcaacgtcagacgcggaagcttcgatcaactacgcggacaggtaccaaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaa

SEQ ID NO: 162 - DNA, 3142 bp, Adeno-associated virus
aaaacgacgggccagtgattgtaatacgactcactatagggcgaaattgaaattagcggccgcgaattcgcctttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagacttgttgtagttggaagtgtactgaatttcgggattccagcgtttgctgttctccttctgcagctcccactcgatctccacgctgacctgtcccgtggaatactgtgtgatgaaagaagcaaacttggcagaactgaagtttgtgggaggattggctggaacgggagtgtttttgatcatgatctgaggaggcgggtgtttgagtccaaaacctcccatcagtggagaaggatgaaagtgtccatcggtgtgaggaatcttggcccaaatgggtccctgcaggtacacgtctcgatcctgccacaccataccaggtaacgctccttggtgattgacagttccagtagttggaccagtgtttgagttttgcaaattatttgacacagtcccgtactgctccgtagccacgggattggtggccctgatttcttcttcatctgtaatcatgacattttccaaatccgcgtcgttggcatttgttccttgtttaccaaatatcagggttccatgcatggggaaaaacttttcttcgtcatccttgtgactggccatagctggtcctggattaaccaacgagtcccggccatttagatgatactttgtagctgcagtccagggaaagttgctgttgttgttgtcgtttgcctgttttgacagacgctgctgtctgtagcaaggtccaggcagccagtttttagcttgaagagacatgttggttggtccagcttggctaaacagtagccgagactgctgaagagttccactatttgtttgtgtcttgttcagataatacaggtactggtcgatcagaggattcatcagccgatccagactctggctgtgagcgtagctgctgtggaaaggcacgtcttcaaaagtgtagctgaactgaaagttgtttccagtacgcagcatctgagaaggaaagtactccaggcagtaaaaggaagagcgtcctaccgcctgactcccgttgttcagggtgaggtatccatactgtgggaccatgaagacgtccgctggaaacggcgggaggcatccttgatgcgccgagcccaggacgtacgggagctggtactccgagtcagtaaacacctgaaccgtgctggtaaggttattggcaatcgtcgtcgtaccgtcattctgcgtgacctctttgacttgaatattaaagagcttgaagttgagtcttttgggccggaatccccggttgttgttgacgagtctttgccagtcacgtggtgaaaagtggcagtggaatctgttgaagtcaaaatacccccagggggtgctgtagccaaagtagtggttgtcgttgctggctcctgattggctggagatttgcttgtagaggtggttgttgtatgtgggcagggcccaggttcgggtgctggtggtgatgactctgtcgcccagccattgggaatcgcaatgccaatttcctgaggaattacccactccatcggcaccctcgttattgtctgccattggtgcgccactgcctgtagccattgtagtagatcccagaccagagggggctgctggtggctgtccgagaggctgggggtcaggtacggagtctgcgtctccagtctgaccaaaatttaatctttttcttgcaggctgctggcccgcttttccggttcccgaggaggagtctggctccacaggagagtgctctaccggcctcttttttcccggagccgtcttaacaggctcctcaaccaggcccagaggttcaagaaccctctttttcgcctggaagactgctcgtccgaggttgcccccaaaagacgtatcttctttaaggcgctcctgaaactctgcgtcggcgtggttgtacttgaggtacgggttgtctccgctgtcgagctgccggtcgtaggccttgtcgtgctcgagggccgcggcgtctgcctcgttgaccggctcccccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttagctccaccctttttgacgtagaattcatgctccacctcaaccacgtgatcctttgcccaccggaaaaagtctttcacttcctgcttggtgacctttccaaagtcatgatccagacggcgggtaagttcaaatttgaacatccggtcttgcaacggctgctggtgctcgaaggtcgttgagttcccgtcaatcacggcgcacatgttggtgttggaggtgacgatcacgggagtcgggtctatctgggccgaggacttgcatttctggtccacacgcaccttgcttcctccaagaatggctttggccgactccacgaccttggcggtcatcttcccctcctcccaccagatcaccatcttgtcgacgcaatggtaaaaggaaagttctcattgg

SEQ ID NO: 163 - protein, 735 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQDKALLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 164 - protein, 740 aa, Adeno-associated virus 2
MAADGYLPDWLEDTLSEGIRQWWKLKPGPPPPKPAERHKDDSRGLVLPGYKYLGPFNGLDKGEPVNAADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAAA

SEQ ID NO: 165 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATMYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 166 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSEAKFASFITQYSTGQVSVEIEWELQKENSKRWNPEIQYTSNYNKSVNVDFTVDTNGVYSEPRPIGTRYLTRN

SEQ ID NO: 167 - protein, 739 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLLAA

SEQ ID NO: 168 - protein, 725 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRP

SEQ ID NO: 169 - protein, 707 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSCIYQPPERQQTSSYRRCQHTRRSSRHGLAGQRCVPSGAHLGKDSTHGRTFSPLSPHGWIRTTPSSTDSHQEHPGTCESFDHLQCGKVCFLHHTVLHGTGQRGDRVRAAEGKQQTLESRNSVHFQLQQVC

SEQ ID NO: 170 - protein, 739 aa, Adeno-associated virus 2; identical to SEQ ID NO: 167

SEQ ID NO: 171 - protein, 737 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHHPPQILIKNTPVPANPSTTFSAAKFASFITQYSTGQVSVEIEWELQKENSKRWNPEIQYTSNYNKSVNVDFTVDTNGVYSEPRPIGTRYLTRNLL

SEQ ID NO: 172 - protein, 741 aa, Adeno-associated virus 2
MAADGYLPDWLEDTLSEGIREWWALKPGAPKPKANQQKQDDGRGLVLPGYKYLGPFNGLDKGEPVNEADAAALEHDKAYDQQLQAGDNPYLRYNHADAEFQERLQEDTSFGGNLGRAVFQAKKRVLEPLGLVEEPVKTAPGKKRPVEHSPVEPDSSSGTGKSGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNLANHNNTTNARQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYL

SEQ ID NO: 173 - protein, 730 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTR

SEQ ID NO: 174 - protein, 735 aa, Adeno-associated virus 2
  MOD_RES (239)..(239): Any amino acid
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRXITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 175 - protein, 733 aa, Adeno-associated virus 2
MASDGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFLAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLT

SEQ ID NO: 176 - protein, 734 aa, Adeno-associated virus 2
MAADGYLPDWLEDTLSEGIRQWWKLKPGPPPPKPAERHKDDSRGLVLPGCKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFSDSEYQLPYVLGSAHQGCLPPFPADVFMIPQYGYLTLNNGSQAVGRSSFYCLEYFPSQMLRTGNNFTFNYTFEDVPFHSSYAHSQSLDRLMNPLIDQYLYYLNRTQNQSGSAQNNDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 177 - protein, 734 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALSTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSINVDFTVDTNGVYSEPRPIGTRYLTRN

SEQ ID NO: 178 - protein, 738 aa, Adeno-associated virus 2
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNLLRP

SEQ ID NO: 179 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 180 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 181 - DNA, 2208 bp, Adeno-associated virus
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 182 - protein, 735 aa, Adeno-associated virus
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 183 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 184 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 185 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgcccttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatgggaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 186 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRPSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 187 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 188 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 189 - DNA, 3161 bp, Adeno-associated virus
gattgaatttagcggccgcgaattcgcccttgctgcgtcaactggaccaatgagaactttccattcaatgattgcgtcgacaagatggtgatctggtgggaggagggaaagatgaccgccaaggtcatggagtcggccaaagccattctcggaggaagcaaggtgcgcgtggaccagaaatgtaagtcctcggcccagatagacccgactcccgtgattgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgggtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaggactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaaccctgcaggactagtccctttagtgagg

SEQ ID NO: 190 - DNA, 3162 bp, Adeno-associated virus
gaattgaatttagcggccgcgaattcgcccttcgcagagaccaaagttcaactgaaacgaattaaacggtttattgattaacaagcaattacagattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaagtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccgtactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagccgctgtggaaaggaacgtcctcaaaagtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtttgtagaggtggttgttgtaggtgggcagggcccaggttcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcctggagccgtcttgacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 191 - DNA, 3164 bp, Adeno-associated virus
gcgaattgaatttagcggccgcgaattcgcccttcgcagagaccaaagttcaactgaaacgaattaaacggtttattgattaacaagcaattacaaattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaggtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccatactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagctgctgtggaaaggaacgtcctcaaaagtgtagctgaaggtaaagttgtttccggtacgcagcatctgagaaggaaagtactccgggcagtaaaatgaagagcgtcctactgcctgactcccgttgctcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtctgtagaggtggttgttgtaggtgggcagggcccaggttcgggtgctggtggtgatgactctgtcgcccatccatgtggaatcgcaatgccgatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcccggagccgtcttaacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggcccacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 192 - DNA, 3163 bp, Adeno-associated virus
accctcactaaagggactagtcctgcaggtttaaacgaattcgcccttgctgcgtcaactggagcaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatggattctacgtcaaaaagggtggagccaagaaaagacccgcccctagtgacgcagatataagtgagcccaaacgggtgcgcgagtcagttgcgcagccatcgacgtcggacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgcgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcgcc

SEQ ID NO: 193 - protein, 735 aa, Adeno-associated virus
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 194 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 195 - DNA, 3161 bp, Adeno-associated virus
cgaattgatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactggatctcgggattccagcgtttgctgttctccttctgtagctcccactcgatctccacgctgacccgccccgtggaatactgtgtgatgaaggaagcaaactttgccgcactgaaggtggtcgaaggattcgcaggtaccggggtgtttttgatgagaatctgtggaggagggtgtttaagtccgaatccgcccatgaggggagaggggtgaaaatgtccgtccgtgtgcggaatctttgcccagataggcccctgcaggtacacgtctctgtcctgccagaccatgcctggaagaacgccttgtgtgttgacatctgcagtagatgcttgtgtgttgccgctctggaggttggtagatacagaaccatactgctccgtggccacgggattggtggttctgatttcctcttcgtctgtaatcatgaccttttcaatgtccacatttgttttctctgatccttgttttccaaagatgagaaccccgctctgaggaaaaaacttttcttcatcgtccttgtggctggccattgccgggcccggattcaccagagagtctctgccattgaggtggtacttggtagctccaatccacgagtattcactgttgttgttgtccgcagatgtctttgatactcgctgctggcggtaacagggtccaggaagccagttcctagactgatcccgaatgtcactcgctccggcctgagaaaactgaagcctggactgcgtggtggttccgcttggagtgtttgttctgctcaagtaatacaggtactggtcgatgagaggattcatgagacggtccaaactctggctgtgagcgtagctgctgtggaaaggaacatcctcaaaggtgtagctgaaggtaaagttgtttccggtacgcagcatctgagaagggaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccatcattctgcgtgacctctctgacttgaatgttaaagagcttgaagttgagtctcttgggccggaatccccagttgttgttgatgagtctttgccagtcacgtggtgaaaagtggcagtggaatctgttgaagtcaaaatacccccaaggggtgctgtagccaaagtagtggttgtcgttgctggctcctgattggctggaaatctgcttgtacagatggttgttgtaggtgggcagagcccaggttcgggtgctggtggtgatgactctgtcgcccatccatgtggaatcgcaatgccaatttcccgaggaattacccactccgtcggcgccatcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctggttgcccgcttttccggttcccgaggaggagtctggctccacaggagagtgctctaccggcctcttttttcccggagccgtcttaacaggctcctcaaccaggcccagaggttcaagaaccctcttttttgcctggaagactgctcgtccgaggttgcccccaaaagacgtatcttctttaaggcgctcctgaaactccgcgtcggcgtggtcgtacttgaggtacgggttgtctccgctgtcgagctgccggtcgtaggccttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcaaagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttggctccaccctttttgacgtagaattcatgctccacctcaaccacgtgatcctttgcccaccggaaaaagtctttcacttcctgcttggtgaccttcccaaagtcatgatccagacggcgggttagttcaaatttgaacatccggtcttgcaacggctgctggtgttcgaaggtcgttgagttcccgtcaatcacggcgcacatgttggtgttggaggtggcgatcacgggagtcgggtctatctgggccgaggacttgcacttttggtccacgcgcaccttgcttcctccgagaatggcttcggccgattccacgaccttggcggtcatctttccctcctcccaccagatcaccatcttgtcgacacagtcgttgaagggaaagttctcattggtccagttgacgcagcaagggcgaattcgtttaaacctgcaggaactagtcccttagtgagg

SEQ ID NO: 196 - protein, 735 aa, Adeno-associated virus
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 197 - DNA, 2208 bp, Adeno-associated virus
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 198 - protein, 738 aa, Adeno-associated virus
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 199 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 200 - DNA, 3167 bp, Adeno-associated virus
attgaatttagcggccgcgaattcgcccttcgcagagaccaaagttcaactgaaacgaattaaacggtttattgattaacaagcaattacagattacgagtcaggtacctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgatgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccggaatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcttgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctgctggcccgcttttccggttcccgaggaggagtctggctccgcaggagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttggggtacgggttgtctccgctgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagccgtagaaagggcgaattcgtttaaacctgcaggactagtccctttagtgagggt

SEQ ID NO: 201 - DNA, 3161 bp, Adeno-associated virus
aattgaatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgacgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccgggatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcctgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctccttcttgcaggctgctggcccgcttttccggttcccgaggaggagtctggctccgcaagagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttgaggtacgggttgtctccgccgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagcaagggcgaattcgtttaaacctgcaggactagtccctttagtgaggg

SEQ ID NO: 202 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcggaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 203 - DNA, 3172 bp, Adeno-associated virus
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcggcgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcctccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 204 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 205 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 206 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 207 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGEKRPVEHSPAEPDSSSGTGKAGQQPARKRLNFGQTGDADSVPDPQPLGQPPAAPSGLGTNTMASGSGAPMADNNEGADGVGNSSGNWYCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLVGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 208 - DNA, 2209 bp, Adeno-associated virus
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 209 - protein, 735 aa, Adeno-associated virus
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 210 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 211 - protein, 735 aa, Adeno-associated virus
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 212 - DNA, 2208 bp, Adeno-associated virus
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 213 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 214 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 215 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 216 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 217 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 218 - DNA, 2208 bp, Adeno-associated virus; identical to SEQ ID NO: 212

SEQ ID NO: 219 - protein, 735 aa, Adeno-associated virus; identical to SEQ ID NO: 213

SEQ ID NO: 220 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 221 - protein, 735 aa, Adeno-associated virus
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 222 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 223 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 224 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 225 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 226 - DNA, 2208 bp, Adeno-associated virus
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 227 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 228 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 229 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 230 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 231 - protein, 735 aa, Adeno-associated virus; identical to SEQ ID NO: 230

SEQ ID NO: 232 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 233 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 234 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaggatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacagctttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttctttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 235 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNSFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 236 - DNA, 2211 bp, Adeno-associated virus; identical to SEQ ID NO: 126

SEQ ID NO: 237 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 238 - DNA, 2211 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 239 - protein, 736 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 240 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccggcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 241 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTGTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 242 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 243 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 244 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 245 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 246 - DNA, 2208 bp, Adeno-associated virus
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtactcgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagcaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtccgttaatgtggactttactgtggacactaatggcgtgtattcagagcctcgccccattggcaccagatacctgactcgtaatctgtaa

SEQ ID NO: 247 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAAGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 248 - protein, 738 aa, Adeno-associated virus; identical to SEQ ID NO: 90

SEQ ID NO: 249 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 250 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNCHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 251 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPTVGAVNSQGALPGMVWQNRDVYLQGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 252 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 253 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 254 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 255 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLSFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNSEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 256 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 257 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 258 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 259 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 260 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 261 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 262 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 263 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 264 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 265 - DNA, 2211 bp, Adeno-associated virus
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 266 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 267 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 268 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 269 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 270 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 271 - DNA, 2211 bp, Adeno-associated virus
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 272 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 273 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 274 - DNA, 2208 bp, Adeno-associated virus
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 275 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 276 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 277 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 278 - DNA, 2211 bp, Adeno-associated virus
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 279 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 280 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 281 - protein, 737 aa, Adeno-associated virus
RMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGANSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 282 - DNA, 2208 bp, Adeno-associated virus
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 283 - protein, 735 aa, Adeno-associated virus
MAADGYLPDWLKDTLSEGIRQWWKLKPGPPPPKPAERHKDDSGGLVLPGYKYLGPFNGLDKGEPVNEADAAALEYDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGSWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVHLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 284 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcgcaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 285 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASRKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 286 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 287 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSGYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 288 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 289 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNRHCDSTWMGDRVITTSTRTWALPTYNNHLYRQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLSNGSQAVGRSSFYCPEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGPKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 290 - DNA, 2205 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 291 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 292 - DNA, 3160 bp, Adeno-associated virus
acccttcactaaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcgggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaatcaatcg

SEQ ID NO: 293 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 294 - DNA, 3157 bp, Adeno-associated virus
ctcactaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccactctcggaggaagcaaggtgcgcgtggaccagaaacgcaagtcctcggcccagatagatccgactcccgtgatcgtcacctccaacaccaacatgtgcgccgtgattgacgggaactcaacgaccttcgaacaccagcagccgttgcaagaccgaatgttcaaatttgaactcacccgccgtctggatcatgacttcgggaaggtcaccaagcaggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcg

SEQ ID NO: 295 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 296 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 297 - DNA, 3159 bp, Adeno-associated virus
gattgatttagcggccgcgaattcgcccttgctgcgtcaactggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtccatagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgagg

SEQ ID NO: 298 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 299 - DNA, 2205 bp, Adeno-associated virus
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 300 - DNA, 3156 bp, Adeno-associated virus
cgattgaatttagcggccgcgaattcgcccttgctgcgtcaacggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagcgaatgaatcagaattcaaatatctgcttcactcacggacagaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 301 - protein, 734 aa, Adeno-associated virus
MAADGYLPDWLEDTLSEGIRQWWKLKPGPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNEGADGVGNSSGDWHCDSTWMGDRVITTSTRTWALPTYNNHLYKQISSQSGASNDNHYFGYSTPWGYFDFNRFHCHFSPRDWQRLINNNWGFRPKRLNLKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNGEYSWTGATKYHLNGRDSLVNPGPAMASHKDDEEKFFPQSGVLIFGKQGSEKTNVDIEKVMITDEEEIRTTNPVATEQYGSVSTNLQSGNTRAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 302 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 303 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYDHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNDGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVREVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWIGATKYHLNGRDSLVNPGPAMASHKDDEEKFFPQSGVLIFGKQGSEKTNVDIEKVMITDEEEIRTTNPVATEQYGSVSTNLQSGNTQASTADVNTQGVLPGMVWQDRDVYLQGPIWAKIPHTDGHFHPSPLMGGFGLKHPPPQILIKNTPVPANPSTTFSAAKFASFITQYSTGRVSVEIEWELQKENSKRWNPEIQYTSNYNKSVNVDFTVDTNGVYSEPRPIGTRYLTRNL

SEQ ID NO: 304 - DNA, 2217 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 305 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 306 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 307 - DNA, 3158 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgcggaccagaaatgcaagtcctcggcccagatagacccgactcccgtgattgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcgggcaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtga

SEQ ID NO: 308 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 309 - DNA, 3159 bp, Adeno-associated virus
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgattgtcacctccaacaccgacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 310 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 311 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 312 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 313 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSLAEPDSSSGTGKAGQQPARRRLNFGQTGDADSVPDPQPLGQPPAAPSGLGTNTMATGSGAPMADNNEGADGVGNSSGNWHCDSTWMGDRVITTSTRTWALPTYNNHLYRQISSQSGASNDNHYFGYSTPWGYFDFNRFHCHFSPRDWQRLINNNWGSRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLVDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 314 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 315 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 316 - protein, 738 aa, Adeno-associated virus
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 317 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEPPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 318 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 319 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 320 - DNA, 2211 bp, Adeno-associated virus; identical to SEQ ID NO: 1

SEQ ID NO: 321 - DNA, 2208 bp, Adeno-associated virus
atggctgccgatggttatcttccagattggctcgaggacactctctctgaaggaacaagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 322 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccacctgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggagggagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaactgccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 323 - protein, 735 aa, Adeno-associated virus
MAADGYLPDWLEDTLSEGTRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 324 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 325 - protein, 735 aa, Adeno-associated virus
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 326 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 327 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 328 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 329 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 330 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 331 - protein, 736 aa, Artificial Sequence
  Description of Artificial Sequence: Synthetic polypeptide
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 332 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 333 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 334 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcccctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtgtacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 335 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 336 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatgactgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 337 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 338 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgccttttcacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 339 - protein, 737 aa, Artificial Sequence; identical to SEQ ID NO: 327
  Description of Artificial Sequence: Synthetic polypeptide

SEQ ID NO: 340 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 341 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 342 - DNA, 2211 bp, Artificial Sequence
  Description of Artificial Sequence: Synthetic polynucleotide
atggctgccgatggttatcttccagattggctcgaggacaaccttagtgaaggaattcgcgagtggtgggcgctgaaacctggagccccgaagcccaaagccaaccagcaaaagcaggacgacggccggggtctggtgcttccgggttacaaatacctcggacccggtaacggactcgacaaaggagagccggtcaacgaggcggacgcggcagccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcccggaaagaaacgtccggtagagcagtcgccacaagagccagactcctctacgggcatcggcaagaaaggccaacagcccgccagaaaaagactcaatttcggtcagactggcgactcagagtcagttccagaccctcaacctctcggagaacctccagcagcgccctctggtgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaacacctacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 343 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPGNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPARKRLNFGQTGDSESVPDPQPLGEPPAAPSGVGPTTMASGGGAPMADNNEGADGVGNASGNWHCDSTWLGDRVITTSTRTWALPTYNNHLYKQISSASTGASNDNTYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 344 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 345 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPADPPTTFNQSKLNSFITQYSTGQVSVEIEWELQKENSKRWNPEVQYTSNYAKSANVDFTVDNNGLYTEPRPIGTRYLTRPL

SEQ ID NO: 346 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagtgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaggagagcgccggagcttcaaacactgcattggacaatgtcatgatcaccgacgaagaggaaatcaaagccactaaccccgtggccaccgaaagatttgggactgtggcagtcaatctccagagcagcagcacagaccctgcgaccggagatgtgcatgttatgggagccttacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 347 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKWVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 348 - DNA, 2214 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctgcaggcgggtgacaatccgtacctgcggtataaccacgccgacgccgagtttcaggagcgtctgcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggggtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctcggcgcaccagggctgcctccctccgttcccggcggacgtcttcatggtgccacagtatggatacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggacttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 349 - protein, 737 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLQAGDNPYLRYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMVPQYGYLTLNNGSQAVGRSSFYCLEYFPSQMLRTGNNFTFSYTFEEVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGDLPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 350 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaactgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatctgggccaagattcctcacacggacggcaacttccacccgtctccgctgatgggcggctttggcctgaaacatcctccgcctcagatcctgatcaagaacacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttaccaaacctctgtaa

SEQ ID NO: 351 - protein, 734 aa, Artificial Sequence
  Description of Artificial Sequence: Synthetic polypeptide
MAADGYLPDWLEDNLSEGIREWWALKPGVPQPKANQQHQDNCRGLVLPGYKYLGPGNGLDKGEPVNEADAAALEHDKAYDQQLKAGDNPYLKYNHADAEFQERLKEDTSFGGNLGRAVFQTKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTKPL

SEQ ID NO: 352 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagcccctaaacccaaggcaaatcaacaacatcaggacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagagaccggtagagccatcaccccagcgttctccagactcctctacgggcatcggcaagaaaggccaacagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttttcaccacgtgactggcaaagactcatcaacaacaactggggattccgacccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaagccgtgggacgttcatccttttactgcctggaatatttcccttctcagatgctgagaacgggcaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgcgtttctaaaacaaaaacagacaacaacaacagcaattttacctggactggtgcttcaaaatataaccttaatgggcgtgaatctataatcaaccctggcactgctatggcctcacacaaagacgacgaagacaagttctttcccatgagcggtgtcatgatttttggaaaagagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 353 - protein, 736 aa, Artificial Sequence
  Description of Artificial Sequence: Synthetic polypeptide
MAADGYLPDWLEDNLSEGIREWWDLKPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEPSPQRSPDSSTGIGKKGQQPAKKRLNFGQTGDSESVPDPQPLGEPPATPAAVGPTTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 354 - DNA, 2214 bp, Artificial Sequence; identical to SEQ ID NO: 326
  Description of Artificial Sequence: Synthetic polynucleotide

SEQ ID NO: 355 - protein, 737 aa, Artificial Sequence; identical to SEQ ID NO: 327
  Description of Artificial Sequence: Synthetic polypeptide

SEQ ID NO: 356 - DNA, 2205 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcagcgactcatcaacaacaactggggattccggcccaagagactcagcttcaagctcttcaacatccaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaaacacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 357 - protein, 734 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSQSGASNDNHYFGYSTPWGYFDFNRFHCHFSPRDWQRLINNNWGFRPKRLSFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTSVDFAVNTEGVYSEPRPIGTRYLTRNL

SEQ ID NO: 358 - DNA, 2217 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccctctcccctcatgggtggattcggacttaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 359 - protein, 738 aa, Artificial Sequence; identical to SEQ ID NO: 105
  Description of Artificial Sequence: Synthetic polypeptide

SEQ ID NO: 360 - DNA, 2211 bp, Artificial Sequence
  Description of Artificial Sequence: Synthetic polynucleotide
atggctgctgacggttatcttccagattggctcgaggacaacctttctgaaggcattcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaggtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccccattggcacccgttaccttacccgtcccctgtaa

SEQ ID NO: 361 - protein, 736 aa, Artificial Sequence; identical to SEQ ID NO: 331
  Description of Artificial Sequence: Synthetic polypeptide

SEQ ID NO: 362 - DNA, 2211 bp, Artificial Sequence; identical to SEQ ID NO: 330
  Description of Artificial Sequence: Synthetic polynucleotide

SEQ ID NO: 363 - protein, 736 aa, Artificial Sequence; identical to SEQ ID NO: 331
  Description of Artificial Sequence: Synthetic polypeptide

SEQ ID NO: 364 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 365 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 366 - DNA, 2217 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcaacggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 367 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADATALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 368 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacctgggccctgcccacctacaacaaccacctctacaaacaaatttccagccaatcaggagcctcgaacgacaatcactactttggctacagcaccccttgggggtattttgatttcaacagattccactgccacttttcaccacgtgactggcagcgactcatcaacaacaattggggattccggcccaagagactcagcttcaagctcttcaacatccaggtcaaggaggtcacgcagaatgaaggcaccaagaccatcgccaataaccttaccagcacggttcaagtgtttacggactcggagtatcagctcccgtacgtgctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctgattgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggactatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccgtctccgctgatgggcggctttggcctgaaacatcctccgcctcagatcctgatcaagaacacgcctgtacctgcggatcctccgaccaccttcaaccagtcaaagctgaactctttcatcactcagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 369 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDYEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 370 - DNA, 2214 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgatttcaacagattccactgccatttctcaccacgtgactggcagcgactcatcaacaacaattggggattccggcccaagagactcaacttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacgacaaatacgcagactctgggcttcagccaaggtgggcctaatacaatggccaatcaggcaaagaactggctgccaggaccctgttaccgccagcagcgagtatcaaagacatttgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctccgcctcagatcctgatcaagaacacgcctgtacccgcggatcctccgaccaccttcaaccagtcaaagctgaactctttcatcacccagtattctactggccaagtcagcgtggagatcgagtgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 371 - protein, 737 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPARKRLNFGQTGDADSVPDPQPLGQPPAAPSGLGTNTMATGSGAPMADNNEGADGVGNSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTFADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 372 - DNA, 2217 bp, Artificial Sequence
  Description of Artificial Sequence: Synthetic polynucleotide
atggctgccgatggttatcttccagattggctcgaggacactctctctgaaggaataagacagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgactttaaccgcttccactgccacttctcgccaagagactggcaaagactcatcaacaacaattggggattccggcccaagagactcaacttcaaactcttcaacatccaagtcaaggaggtcacgacgaatgatggcgtcacgaccatcgccaataacctcaccagcaccatccaggtgtttacggactcggagtaccagctgccgtacgttctcggctctgcccaccagggctgcctgcctccgttcccggcggacgtgttcatgattccccagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcagccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaggggcccatctgggcaaagattccacacacggacggacattttcacccctctcccctcatgggtggattcggacttaaacaccctcctccgcagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 373 - protein, 738 aa, Artificial Sequence
  Description of Artificial Sequence: Synthetic polypeptide
MAADGYLPDWLEDTLSEGIRQWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYYKSNNVEFAVNTEGVYSEPRPIGTRYLTRNL

SEQ ID NO: 374 - DNA, 2208 bp, Artificial Sequence; identical to SEQ ID NO: 10
  Description of Artificial Sequence: Synthetic polynucleotide

SEQ ID NO: 375 - protein, 735 aa, Artificial Sequence [sequence omitted]

SEQ ID NO: 376 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgccgcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaaaaagaggcttcttgaacctcttggtctggttgaggaagcagctaaaacggctcctggaaagaagaggcctgtagagcagtctcctcaggaaccggactcctccgcgggtattggcaaatcgggtgcacagcccgccaaaaagagactcaatttcggtcagactggcgactcagagtcagtcccagaccctcaacctctcggagaaccaccagcagcccccacaagtttgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacagcaaccatctctacaagcaaatctccagccaatcaggagcttcaaacgacaacgactactttggctacagcaccccttgggggtattttgatttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgaggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 377 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRLLEPLGLVEEAAKTAPGKKRPVEQSPQEPDSSAGIGKSGAQPAKKRLNFGQTGDSESVPDPQPLGEPPAAPTSLGSNTMASGGGAPMADNNEGADGVGNASGNWHCDSTWLGDRVITTSTRTWALPTYSNHLYKQISSQSGASNDNDYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSEDNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 378 - DNA, 2208 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagttccaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtcccagaccctcaacctctcggagaaccaccagcagcccccacaagtttgggatctaatacaatggcttcaggcggtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcttcaaacgacaaccactactttggctacagcaccccttgggggtattttgactttaacagattccactgccacttttcaccacgtgactggcagcgactcattaacaacaactggggattccggcccaagaaactcaacttcaagctctttaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtattacttgtctcggactcaaacaacaggaggcacgacaaatacgcagactctgggcttcagccaaggtgggcctaatacaatggccaatcaggcaaagaactggctgcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggttatgattacagacgaagaggaaatcaggacaaccaatcccgtggctacggagcagtatggttctgtatctaccaacctccagagaggcaacagacaagcagctaccgcagatgtcaacacacagggcgttcttccaggcatggtctggcaggacagagatgtgtaccttcagggtcccatttgggccaaaattcctcacacagatggacactttcacccgtcccctcttatgggcggctttggactcaagaacccgcctcctcagatcctcatcaaaaacacgcctgttcctgcgaatcctccggcagagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacactaatggcgtgtattcagagcctcgccccattggcaccagatacctcacccgtaatctgtaa

SEQ ID NO: 379 - protein, 735 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPAAPTSLGSNTMASGGGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKKLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTTNTQTLGFSQGGPNTMANQAKNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDTNGVYSEPRPIGTRYLTRNL

SEQ ID NO: 380 - DNA, 2214 bp, Artificial Sequence; identical to SEQ ID NO: 370
  Description of Artificial Sequence: Synthetic polynucleotide

SEQ ID NO: 381 - protein, 737 aa, Artificial Sequence; identical to SEQ ID NO: 371
  Description of Artificial Sequence: Synthetic polypeptide

SEQ ID NO: 382 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 383 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGQTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVSPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 384 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 385 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGRQPAKKRLNFGQTGDSESVPDPQPLSEPPAGPSGLGSGTMAAGGGAPMADNNEGADGVGNASGNWHCDSTWLGDRVITTSTRTWALPTYNNHLYKQISNGTSGGSSNDNTYFGYSTPWGYFDFNRFHCHFSPRDWQRLINNNWGFRPKRLNFKLFNIQVKEVTQNEGTKTIANNLTSTVQVFTDSKYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 386 - DNA, 2196 bp, Adeno-associated virus
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 387 - protein, 731 aa, Adeno-associated virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGPTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTTANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTAVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 388 - DNA, 4404 bp, Adeno-associated virus
atggctgccgatggttatcttccagattggctcgagggcaacctctctgagggcattcgcgagtggtgggacttgaaacctggagccccgaaacccaaagccaaccagcaaaagcaggacgacggccggggtctggtgcttcctggctacaggtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaacggccagccgcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcgataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaaatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaa

SEQ ID NO: 389 - protein, 738 aa, Adeno-associated virus; identical to SEQ ID NO: 7

SEQ ID NO: 390 - DNA, 3129 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaagtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaagtttgaactcacccgccgtctggagcacgactttggcaaggtgacaaagcaggaagtcagagagttcttccgctgggcgcaggatcacgtgaccgaggtggcgcacgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaaaaagacgtatcggaaactctgtgcgattcatcatctgctgggggcgggcacccgagattgcttgctcggcctgcgatctggtcaacgtggacctagatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacttcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcctggaccggtgccaccaagtatcatctgaatggcagagactctctggtaaatcccggtgtcgctatggcaacccacaaggacgacgaagagcgattttttccgtccagcggagtcttaatgtttgggaaacagggagctggaaaagacaacgtggactatagcagcgttatgctaaccagtgaggaagaaattaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcggatcctccaactaccttcagtcaagctaagctggcgtcgttcatcacgcagtacagcaccggacaggtcagcgtggaaattgaatgggagctgcagaaagaaaacagcaaacgctggaacccagagattcaatacacttccaactactacaaatctacaaatgtggactttgctgttaacacagatggcacttattctgagcctcgccccatcggcacccgttacctcacccgtaatctgtaattgcttgttaatcaataaaccggttgattcgtttcagttgaactttggtctctgcgaagggcgaattc

SEQ ID NO: 391 - protein, 738 aa, Artificial Sequence; identical to SEQ ID NO: 7
  Description of Artificial Sequence: Synthetic polypeptide

SEQ ID NO: 392 - protein, 733 aa, Artificial Sequence
  Description of Artificial Sequence: Synthetic polypeptide
MAADGYLPDWLEDNLSEGIREWWDLRPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 393 - DNA, 2501 bp, Adeno-associated virus
gaattcgcccttggctgcgtcaactggaccaatgagaactttcccttcaacgattgcgtcgacaagatggtgatctggtgggaggagggcaagatgacggccaaggtcgtggagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgagacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagagactcaactttgggcagactggcgactcagagtcagtgcccgaccctcaaccaatcggagaaccccccgcaggcccctctggtctgggatctggcacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtagactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttgattcgtttcagttgaactttggtctcaagggcgaattc

SEQ ID NO: 394 - DNA, 2187 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcgaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaa

SEQ ID NO: 395 - protein, 728 aa, Adeno-associated virus; identical to SEQ ID NO: 63

SEQ ID NO: 396 - protein, 728 aa, Adeno-associated virus; identical to SEQ ID NO: 155

SEQ ID NO: 397 - protein, 728 aa, Adeno-associated virus; identical to SEQ ID NO: 155

SEQ ID NO: 398 - protein, 733 aa, Artificial Sequence
  Description of Artificial Sequence: Synthetic polypeptide
MAADGHLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNSWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 399 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgcttccctgcaagacatgcgagagaatgaatcagaatttcagcatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggtcatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatagctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacagctggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 400 - protein, 731 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFRAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNRGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMAWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 401 - DNA, 3106 bp, Adeno-associated virus
gaattcgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggcgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcccgcccctcagtcgcggatccatcgacgtcagacgcggaaggagctccggtggactttgccgacaggtaccaaaacaaatgttctcgtcacgcgggcatgcttcagatgctgtttccctgcaaaacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccgggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgacccccaacctctcggagaacctcccgccgcgccctcaggtctgggatctggtacaatggctgcaggcggtggcgcaccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaaccggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctaccagtttgaggacgtgccctttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggcctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 402 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 403 - DNA, 3197 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattcgtttaaacctgcaggactagtccctttagtgagggttaattctgagcttggcgtaatcatgggtcatag

SEQ ID NO: 404 - protein, 735 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPRKLRFKLFNIQVKEVTTDDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMDGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 405 - DNA, 3276 bp, Adeno-associated virus
gaattcgcccttcgcagagaccaaagttcaactgaaacgaattaaccggtttattgattaacaggcaattacaggttacgggtgaggtaacgggtgccaatggggcgaggctcagtataaaccccttcgttgttgacagcaaattccacattattagacttggcataatttgaggtgtactgaatctctggattccagcgtttgctgttttctttctgcagttcccactcgatctccacgctgacctggccggtgctgtactgcgtgataaatgaggcaaacttggcaggagtaaacacctctggaggattagcaggtaccggggtgtttttgatgagaatttgaggaggcgggtgtttgagtccaaatccgtccatcaggggagacgggtgaaagttgccgtccgtgtgaggaattttggcccagatgggaccctgcaggtacacgtcccggttctgccagaccatgccgggcagagccccctggctgttgacagtctgtgtctggggtccggccgtagacgattgcaggttgctggagaccacaccgtattcttctgtagccacgggattggtggttttgatctcctcctcgctggtcattagcacgttttccagcgttgtcttgttggcagcccccgttttgccaaaaaccagcactccgttgatgggaaagaactggtcctcgtcgtccttgttggtggccatggctacgcccgggttggttaatgaatttctaccattcagatggtatttagtggccccggtccaggcaaagttactgttgttgttgctgtctatgttttttgacagtctctgctgccgataacagggtccgggcagccagttctttgattgctcggccatggtgttgggcccagcctgatggaactgcagctcccttgtggaccccgtagtgctctgggtccgggccaggtagtacaggtactggtcgatgaggggattcatcagccggtccaggctctggctatgcgcatagctgctgtggaaaggcacttcctcaaaggtgtagctgaattcaaagttattgcccgttctcagcatctgagaaggaaagtactccaggcagtagaaggaggaacgtcccacagactgactgccgttgtttagagtcagatatccgtactgaggaatcatgaacacgtccgcagggaacggagggaggcagccctggtgcgcagagccgaggacgtacggcagttggtactccgagtccgagaagacctgaatcgtgctggtaaggttattagcgatggtcgtaacgccgtcgtccgtcgtgacctccttgacctggatgttgaacaacttgaaccgcagctttctgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgatgtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgcggggggttctccgattggttgagggtcgggcactgactctgagtcgccagtctgcccaaagttgagtctctttttcgcgggctgctggcctgtcttgccgatgcccgtagaggagtctggagaacgctggggtgatggctctaccggtctcttctttccaggagccgtcttagcgccttcctcaaccagaccgagaggttcgagaacccgcttcttggcctggaagactgctcgcccgaggttgcccccaaaagacgtatcttcttgaagacgctcctgaaactcggcgtcggcgtggttgtacttgaggtacgggttgtccccctgctcgagctgcttgtcgtaggccttgtcgtgctcgagggccgcggcgtctgcctcgttgaccggctctcccttgtcgagtccgttgaagggtccgaggtacttgtagccaggaagcaccagaccccggccgtcgtcctgcttttgctggttggctttgggtttcggggctccaggtttcaagtcccaccactcgcgaatgccctcagagaggttgtcctcgagccaatctggaagataaccatcggcagccatacctggtttaagtcatttattgctcagaaacacagtcatccaggtccacgttgaccagatcgcaggccgagcaagcaatctcgggagcccgccccagcagatgatgaatggcacagagtttccgatacgtcctctttctgacgaccggttgagattctgacacgccggggaaacattctgaacagtctctggtcccgtgcgtgaagcaaatgttgaaattctgattcattctctcgcatgtcttgcagggaaacagcatctgaagcatgcccgcgtgacgagaacacttgttttggtacctgtcggcaaagtccaccggagctccttccgcgtctgacgtcgatggatgcaaaatgtcgcaaaagcactcacgtgacagctaatacaggaccactcccctatgacgtgatttacgtcagcgctatgcccgcgtgacgagaacatttgttttggtacctgtcggcaaagtccaccggagctccttccgcgtctgacgtcgatggatccgcgactgaggggcaggcccgcttgggctcgcttttatccgcgtcatcgggggcgggtctcttgttggctccaccctttctgacgtagaactcatgcgccacctcggtcacgtgatcctgcgcccagcggaagaactctttgacttcctgctttgtcaccttgccaaagtcatgctccagacggcgggtgagttcaaatttgaacatccggtcctgcaacggctgctggtgctcgaaggtggtgctgttcccgtcaatcacggcgcacatgttggtgttggaagtgacgatcacgggggtgggatcgatctgggcggaagacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagccgtagaaagggcgaattc

SEQ ID NO: 406 - protein, 738 aa, Adeno-associated virus; identical to SEQ ID NO: 71

SEQ ID NO: 407 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 408 - protein, 738 aa, Adeno-associated virus; identical to SEQ ID NO: 69

SEQ ID NO: 409 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGRKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 410 - DNA, 2489 bp, Adeno-associated virus
gaattcgccctttctacggctgcgtcaactggaccaatgagaactttcccttcaacgattgcgtcgacaagatggtgatctggtgggaggagggcaagatgacggccaaggtcgtgaagtccgccaaggccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaggaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgccaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagaaaacagcaaacgctggaatccagagattcagtacacctcaaattatgccaagtctaataatgtggaatttgctgtcaacaacgaaggggtttatactgagcctcgccccattggcacccgttacctcacccgtaacctgtaattgcctgttaatcaataaaccggttaattcgtttcagttgaactttggtcaagggcgaattc

SEQ ID NO: 411 - protein, 728 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRRQRLSKDIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 412 - DNA, 3098 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcttccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccggagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtaatgcctccggaaattggcattgcgattccacatggctgggcgacagagtcatcaccaccagcacccgcacctgggccctgcccacctacaacaaccacctctacaagcagatatcaagtcagagcggggctaccaacgacaaccacttcttcggctacagcaccccctggggctattttgacttcaacagattccactgccacttctcaccacgtgactggcagcgactcatcaacaacaactggggattccggcccagaaagctgcggttcaagttgttcaacatccaggtcaaggaggtcacgacgaacgacggcgttacgaccatcgctaataaccttaccagcacgattcaggtcttctcggactcggagtaccaactgccgtacgtcctcggctctgcgcaccagggctgcctccctccgttccctgcggacgtgttcatgattcctcagtacggatatctgactctaaacaacggcagtcagtctgtgggacgttcctccttctactgcctggagtactttccttctcagatgctgagaacgggcaataactttgaattcagctacacctttgaggaagtgcctttccacagcagctatgcgcacagccagagcctggaccggctgatgaatcccctcatcgaccagtacctgtactacctggcccggacccagagcactacggggtccacaagggagctgcagttccatcaggctgggcccaacaccatggccgagcaatcaaagaactggctgcccggaccctgttatcggcggcagagactgtcaaaagacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaaaaacaccccggtacctgctaatcctccagaggtgtttactcctgccaagtttgcctcatttatcacgcagtacagcaccggccaggtcagcgtggagatcgagtgggaactgcagaaagagaacagcaaacgctggaatccagagattcagtacacctcaaattatgccaagtctaataatgtggaatttgctgtcaacaacgaaggggtttatactgagcctcgccccattggcacccgttacctcacccgtaacctgtaattacttgttaatcaataaaccggttgattcgtttcagttgaactttggtctctgcgaagggcgaattc

SEQ ID NO: 413 - protein, 685 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLTNPLIDQYLYYLARTQSTTGSTRGLQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKYTSNYYKSTNVDFAVNTEGTYSEPRPIGTRYLTRNL

SEQ ID NO: 414 - DNA, 2969 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttacaagaccggatgttcaaatttgaactcacccgccgtctggagcacgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggagagccggtcaacgaggcagacgccgcggccctcgagcacgacaaggcctacgacaagcagctcgagcagggggacaacccgtacctcaagtacaaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctacgcgcacagccaaagcctggaccggctgacgaaccccctcatcgaccagtacctgtactacctggcccggacccagagcactacggggtccacaagggggctgcagttccatcaggctgggcccaacaccatggccgagcaatcaaagaactggctgcccggaccctgttatcggcagcagagactgtcaaaaaacatagacagcaacaacaacagtaactttgcctggaccggggccactaaataccatctgaatggtagaaattcattaaccaacccgggcgtagccatggccaccaacaaggacgacgaggaccagttctttcccatcaacggagtgctggtttttggcaaaacgggggctgccaacaagacaacgctggaaaacgtgctaatgaccagcgaggaggagatcaaaaccaccaatcccgtggctacagaagaatacggtgtggtctccagcaacctgcaatcgtctacggccggaccccagacacagactgtcaacagccagggggctctgcccggcatggtctggcagaaccgggacgtgtacctgcagggtcccatctgggccaaaattcctcacacggacggcaactttcacccgtctcccctgatgggcggatttggactcaaacacccgcctcctcaaattctcatcaagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 415 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRSL

SEQ ID NO: 416 - DNA, 3113 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgatcccacccccgtgatcgtcacttccaacaccaacatgtgcgccgtgattgacgggaacagcaccaccttcgagcaccagcagccgttacaagaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcacgggaccagagactgttcagaatgtttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaagaagcgggttctcgaacctctcggtctggttgaggaaggcgctaagacggctcctggaaagaagagacccatagaatcccccgactcctccacgggcatcggcaagaaaggccagcagcccgctaaaaagaagctcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcctgcctccgttcccggcggacgtcttcatgattcctcagtacgggtacctgactctgaacaacggcagtcaggccgtgggccgttcctccttctactgcctggagtactttccttctcaaatgctgagaacgggcaacaactttgagttcagctaccagtttgaggacgtgccttttcacagcagctatgcgcacagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacagtgtcgcaaaataacaacagcaactttgcttggaccggtgccaccaagtatcatctgaatggcagagactctctggtaaatcccggtgtcgctatggcaacgcacaagggcgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtagcctgtaattgcctgttaatcaataaaccggttgattcgtttcagttgaactttggtctctgcgaagggcgaattc

SEQ ID NO: 417 - protein, 738 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 418 - DNA, 3128 bp, Adeno-associated virus
gaattcgccctttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcatgactttggcaaggtgacaaagcaggaagtcaaagagttcttccgctgggcgcaggatcacgtgaccgaggtggcgcatgagttctacgtcagaaagggtggagccaacaagagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaagacatgcgagagaatgaatcagaatttcaacatttgcttcacgcgcgggaccagagactgttcagaatgtttcccgggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaattgcctgttaatcaataaaccggttaattcgtttcagttgaactttggtctctgcgaagggcgaattc

SEQ ID NO: 419 - protein, 738 aa, Adeno-associated virus; identical to SEQ ID NO: 407

SEQ ID NO: 420 - DNA, 1933 bp, Adeno-associated virus
  modified_base (1302)..(1302): a, c, t, g, unknown or other
caaggcctacgaccagcagctcaaagcgggtgacaatccgtacctgcggtataaccacgccgacgccgagtttcaggagcgtcttcaagaagatacgtcttttgggggcaacctcgggcgagcagtcttccaggccaaaaagcgggttctcgaacctcttggtctggttgagacgccagctaagacggcacctggaaagaagcgaccggtagactcgccagactccacctcgggcatcggcaagaaaggccagcagcccgcgaaaaagagactcaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggccctgcccacctacaacaaccacctctacaagcaaatctccagtcagtcagcagggagcaccaacgataacgtctatttcggctacagcaccccctgggggtattttgacttcaacagattccattgccacttctcaccacgtgactggcagcgacttatcaacaacaactggggattccggcccaagaagctcaacttcaagctcttcaacatccaggtcaaggaggtcacgacgaatgacggtgtcacaaccatcgctaataaccttaccagcacggttcaggtcttttcggactcggaatatcaactgccgtacgtcctcggctccgcgcaccagggctgcctgcctccgttcccggcagacgtgttcatgattccgcagtacggatacctgactctgaacaatggcagccaatcggtaggccgttcctccttctactgcctggagtactttccttctcagatgctgagaacgggcaacaacttcacctttagctacaccttcgaggacgtgcctttccacagcagctacgcgcacagccagagtctggaccggctgatgaatcccctcatcgaccagtacctgtactacttggccagaacacagagcaacgcaggaggtactgctggcaatcgggaactgcagttttatcagggcggacctaccaccatggccgaacaagcaaagaactggctgcccggaccttgcttccggcaacagagagtatccaagacgctggatcaaaataacaacagcaactttgcctggactggtgccacaaaataccatttaaatgnaagaaattcattggttaatcccggtgtcgccatggcaacccacaaggacgacgaggaacgcttcttcccttcgagcggagttctaatttttggcaaaactggagcagctaataaaactacattagaaaacgtgctcatgacaaatgaagaagaaattcgtcctaccaacccggtagctaccgaggaatacgggattgtaagcagcaacttgcaggcggctagcaccgcagcccagacacaagttgttaacaaccagggagccttacctggcatggtctggcagaaccgggacgtgtacctgcaaggtcccatttgggccaagattcctcacacggacggcaactttcacccgtctcctctaatgggtggctttggactgaaacacccgcctccccagatcctgatcaaaaacacaccggtacctgctaatcctccagaagtgtttactcctgccaagtttgcttccttcatcacgcagtacagcaccgggcaagtcagcgttgagatcgagtgggagctgcagaaagagaacagcaagcgctggaacccagagattcagtacacctccaactttgacaaacagactggagtggactttgctgttgacagccagggtgtttactctgagcct

SEQ ID NO: 421 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLSPFPNDVFMVPQYGYCGIVTGENQNQTDRNAFYCLEYFPSQMLRTGNNFEMAYNFGKVPFHSMYAYSQSPDRLMNPLLDQYLWHLQSTTSGETLNQGNAATTFGKIRSGDFAFYRKNWLPGPCVKQQRLSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 422 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcccgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaacctctgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgtctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgggaaggtgccgttccactcaatgtatgcttacagccagagcccggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagactctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaagaagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgctggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 423 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFEMAYNFEKVPFHSMYAHSQSLDRLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDTTGKYTEPRVIGSRYLTNHL

SEQ ID NO: 424 - DNA, 3105 bp, Adeno-associated virus
gaattcgcccttgctgcgtcaactggaccaatgagaactttcccttcaacgattgcgtcgacaagatggtgatctggtgggaggagggcaagatgaccgccaaggtcgtggagtccgccaaggccattctgggcggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagccgctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagctcaaggccaaccagcagaagcaggacgacggccggggtctggtgcttcctggctacaagtacctcggacccttccacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggtactcgaaccactgggcctggttgaagaaggtgctaagacggctcctggaaagaagagaccgttagagtcaccacaagagcccgactcctcctcaggaatcggcaaaaaaggcaaacaaccagccaaaaagagactcaactttgaagaggacactggagccggagacggaccccctgaaggatcagataccagcgccatgtcttcagacattgaaatgcgtgcagcaccgggcggaaatgctgtcgatgcgggacaaggttccgatggagtgggtaatgcctcgggtgattggcattgcgattccacctggtctgagggcaaggtcacaacaacctcgaccagaacctgggtcttgcccacctacaacaaccacttgtacctgcggctcggaacaacatcaaacagcaacacctacaacggattctccaccccctggggatactttgactttaacagattccactgtcacttctcaccacgtgactggcaaagactcatcaacaacaactggggactacgaccaaaagccatgcgcgttaaaatcttcaatatccaagttaaggaggtcacaacgtcgaacggcgagactacggtcgctaataaccttaccagcacggttcagatatttgcggactcgtcgtatgagctcccgtacgtgatggacgctggacaagagggaagtctgcctcctttccccaatgacgtcttcatggtgcctcaatatggctactgtggcattgtgactggcgaaaatcagaaccagacggacagaaatgctttctactgcctggagtattttccttcacaaatgctgagaactggcaataactttgaaatggcttacaactttgagaaggtgccgttccactcaatgtatgctcacagccagagcctggacagactgatgaatcccctcctggaccagtacctgtggcacttacagtcgaccacctctggagagactctgaatcaaggcaatgcagcaaccacatttggaaaaatcaggagtggagactttgccttttacagaaagaactggctgcctgggccttgtgttaaacagcagagattctcaaaaactgccagtcaaaattacaagattcctgccagcgggggcaacgctctgttaaagtatgacacccactataccttaaacaaccgctggagcaacatagcgcctggacctccaatggcaacagctggaccttcagatggggacttcagcaacgcccagctcatcttccctggaccatcagtcaccggaaacacaacaacctcagcaaacaatctgttgtttacatcagaaggagaaattgctgccaccaacccaagagacacggacatgtttggtcagattgctgacaataatcagaatgctacaactgctcccataaccggcaacgtgactgctatgggagtgcttcctggcatggtgtggcaaaacagagacatttactaccaagggccaatttgggccaagatcccacacgcggacggacattttcatccttcaccgctaattggcggttttggactgaaacatccgcctccccagatatttatcaaaaacacccccgtacctgccaatcctgcgacaaccttcactgcagccagagtggactctttcatcacacaatacagcaccggccaggtcgctgttcagattgaatgggaaatcgaaaaggaacgctccaaacgccggaatcctgaagtgcagtttacttcaaactatgggaaccagtcttctatgttgtgggctcccgatacaactgggaagtatacagagccgcgggttattggctctcgttatttgactaatcatttgtaactgcctagttaatcaataaaccgtgtgattcgtttcagttgaactttggtctctgcgaagggcgaattc

SEQ ID NO: 425 - protein, 733 aa, Artificial Sequence
  Description of Artificial Sequence: Synthetic polypeptide
MAADGYLPDWLEDNLSEGIREWWDLKPGAPKPKANQQKQDDGRGLVLPGYEYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQEPDSSSGIGKKGKQPAKKRLNFEEDTGAGDGPPEGSDTSAMSSDIEMRAAPGGNAVDAGQGSDGVGNASGDWHCDSTWSEGKVTTTSTRTWVLPTYNNHLYLRLGTTSNSNTYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGENQNQTDRNAFYCLEYFPSQMLRTGNNFETAYNFEKVPFHSMYAHSQSLDGLMNPLLDQYLWHLQSTTSGETLNQGNAATTFGKIRSGDFAFYRKNWLPGPCVKQQRFSKTASQNYKIPASGGNALLKYDTHYTLNNRWSNIAPGPPMATAGPSDGDFSNAQLIFPGPSVTGNTTTSANNLLFTSEEEIAATNPRDTDMFGQIADNNQNATTAPITGNVTAMGVLPGMVWQNRDIYYQGPIWAKIPHADGHFHPSPLIGGFGLKHPPPQIFIKNTPVPAYPATTFTAARVDSFITQYSTGQVAVQIEWEIEKERSKRWNPEVQFTSNCGNQSSMLWAPDTTGKYTEPRVIGSRYLTNHL

SEQ ID NO: 426 - DNA, 3105 bp, Adeno-associated virus
gaattcgcccttcgcagagaccaaagttcaactgaaacgaatcacacggtttattgattaactaggcagttacaaatgattagtcaaataacgagagccaataacccgcggctctgtatacttcccagttgtatcgggagcccacaacatagaagactggttcccacagtttgaagtaaactgcacttcaggattccagcgtttggagcgttccttttcgatttcccattcaatctgaacagcgacctggccggtgctgtattgtgtgatgaaagagtccactctggctgcagtgaaggttgtcgcaggataggcaggtacgggggtgtttttgataaatatctggggaggcggatgtttcagtccaaaaccgccaattagcggtgaaggatgaaaatgtccgtccgcgtgtgggatcttggcccaaattggcccttggtagtaaatgtctctgttttgccacaccatgccaggaagcactcccatagcagtcacgttgccggttatgggagcagttgtagcattctgattattgtcagcaatctgaccaaacatgtccgtgtctcttgggttggtggcagcaatttcttcttctgatgtaaacaacagattgtttgctgaggttgttgtgtttccggtgactgatggtccagggaagatgagctgggcgttgctgaagtccccatctgaaggtccagctgttgccattggaggtccaggcgctatgttgctccagcggttgtttaaggtatagtgggtgtcatactttaacagagcgttgcccccgctggcaggaatcttgtaattttgactggcagtttttgagaatctctgctgtttaacacaaggcccaggcagccagttctttctgtaaaaggcaaagtctccactcctgatttttccaaatgtggttgctgcattgccttgattcagagtctctccagaggtggtcgactgtaagtgccacaggtactggtccaggaggggattcatcagtccgtccaggctctggctgtgagcatacattgagtggaacggcaccttctcaaagttgtaagccgtttcaaagttattgccagttctcagcatttgtgaaggaaaatactccaggcagtagaaagcatttctgtccgtctggttctgattttcgccagtcacaatgccacagtagccatattgaggcaccatgaagacgtcattggggaaaggaggcagacttccctcttgtccagcgtccatcacgtacgggagctcatacgacgagtccgcaaatatctgaaccgtgctggtaaggttattagcgaccgtagtctcgccgttcgacgttgtgacctccttaacttggatattgaagattttaacgcgcatggcttttggtcgtagtccccagttgttgttgatgagtctttgccagtcacgtggtgagaagtgacagtggaatctgttaaagtcaaagtatccccagggggtggagaatccgttgtaggtgttgctgtttgatgttgttccgagccgcaggtacaagtggttgttgtaggtgggcaagacccaggttctggtcgaggttgttgtgaccttgccctcagaccaggtggaatcgcaatgccaatcacccgaggcattacccactccatcggaaccttgtcccgcatcgacagcatttccgcccggtgctgcacgcatttcaatgtctgaagacatggcgctggtatctgatccttcagggggtccgtctccggctccagtgtcctcttcaaagttgagtctctttttggctggttgtttgccttttttgccgattcctgaggaggagtcgggctcttgtggtgactctaacggtctcttctttccaggagccgtcttagcaccttcttcaaccaggcccagaggttcgagtaccctcttcttggcctggaagactgctcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtactcgtagccaggaagcaccagaccccggccgtcgtcctgcttctgctggttggccttgggcttgggggctccaggtttcaggtcccaccactcgcgaatgccctcagagaggttgtcctcgagccaatctggaagataaccgtcagcagccatacctggtttaagtcatttattgctcagaaacacagtcatccaagtccacgttgacgagatcgcaggccgaacacgcaatctcgggtgcccgccccagcagatgatgaatcgcgcacagtttctgatacgtcttttttctgacgacgggttgagattctgacgcgccggggaagcactctgagcagtctctgaccccgtgcgtgaagcagacgttgaaattctgattcattctctcgcatgtcttgcagggaaacagcatctgaagcatgcccgcgtgacgagaacatttgttttggtacctgtccgcaaggtccaccggtgcttccgcgtctgacgtcgatggctccgcaactgaggggcaggcccgcttgggctcgcttatatccgcgtcactgggggcgggtcttttggtggctccgccctttctgacgtagaactcatgcgccacctcagtcacgtgatcctgagcccagcggaagaactctttgacttcctgcttggtcaccttgccaaagtcgtgctccagacggcgggtgagctcgaacttgaacatgcggtcctgcagcggctgctggtgctcgaaggtggtgctgttcccgtcgatcacggcgcacatgttggtgttggaggtgacgatcacgggcgtggggtcgatctgggccgatgacttgcacttttggtccacgcgcaccttgcttccgcccagaatggccttggcggactccacgaccttggcggtcatcttgccctcctcccaccagatcaccatcttgtcgacgcaatcgttgaagggaaagttctcattggtccagttgacgcagcaagggcgaattc

SEQ ID NO: 427 - protein, 729 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQGLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQPSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLPRNL

SEQ ID NO: 428 - DNA, 3094 bp, Adeno-associated virus
gaattcgcccttgctgcgtcaactggaccaagagaactttcccttcaacgattgcgtcgacaagatggtgatctggtgggaggagggcaagatgacggccaaggtcgtggagtccgccaaagccattctgggcggaagcaaggtgcgcgtcgaccaaaagtgcaagtcctcggcccagatcgatcccacccccgtgatcgtcacctccaacaccaacatgtgcgccgtgatcgacgggaacagcaccaccttcgagcaccagcagccgttgcaggaccggatgttcaaatttgaactcacccgccgtctggaacacgactttggcaaggtgaccaagcaggaagtcaaagagttcttccgctgggctagtgatcacgtgactgaggtgacgcatgagttctacgtcagaaagggcggagccagcaaaagacccgcccccgatgacgcggatataagcgagcccaagcgggcctgtccctcagtcacggacccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacgcacggggtcagagactgtttagaatgtttccccggcgtgtcagaatctcaaccggtcgtcagaaaaaagacgtatcggaagctgtgtgcgattcatcatctgctggggcgggcacccgagattgcttgctcggcctgcgacctggtcaacgtggacctggacgactgtgtttctgagcaataaatgacttaaaccgggtatggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctggaaagaagagacccatagactctccagactcctccacgggcatcggcaaaaaaggccagcagcccgctaaaaagaagctcaattttggtcagactggcgactcagagtcagtccccgaccctcaacctcttggagaacctccagcagcgccctctagtgtgggatctggtacaatggctgcaggcggtggcgcaccaatggcagacaataacgaaggtgccgacggagtgggtaatgcctcaggaaattggcattgcgattccacatggctgggcgacagagtcatcaccaccagcaccagaacctgggccctccccacctacaacaaccacctctacaagcaaatctccagcagcagctcaggagccaccaatgacaaccactacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacaacgaatgacggcgtcacgaccatcgctaataaccttaccagcacggttcaggtcttctcggactcggaataccagctgccgtacgtcctcggctctgcgcaccagggctgcctgcctccgttcccggcggacgtcttcatgattcctcagtacggctacctgactctgaacaacggcagccaatcggtgggccgttcctccttctactgcctggaatatttcccctctcaaatgctgagaacgggcaacaactttgagttcagttacagcttcgaggacgtgcctttccacagcagctacgcgcacagccagagcctagaccggctgatgaaccctctcatcgaccagtacctgtactacctggcccggacccagagcaccacgggttccaccagggaactgcaatttcatcaagctgggcccaatactatggccgagcagtcaaagaactggctgcctggaccctgctataggcaacagggactgtcaaagaacttggactttaacaacaacagcaattttgcctggactgctgccactaaatatcatctgaatggcagaaactctttgaccaatcctggcattcccatggcaaccaacaaggatgatgaggaccagttctttcccatcaacggggtactggtttttggcaagacgggagctgccaacaaaactacgctggaaaacgttctgatgaccagcgaggaggagatcaagaccactaaccctgtggctacagaagaatacggtgtggtctccagcaacctgcagccgtctacagccgggcctcaatcacagactatcaacagccagggagcactgcctggcatggtctggcagaaccgggacgtgtatctgcagggtcccatctgggccaaaattcctcacacggatggcaactttcacccgtctcctctgatgggcggttttggactcaaacacccgcctccacagatcctgatcaaaaacacacctgtacctgctaatcctccggaggtgtttactcctgccaagtttgcctccttcatcacgcagtacagcaccggacaagtcagcgtggaaatcgagtgggagctgcagaaagaaaacagcaagcgctggaacccagaaattcagtatacttccaattatgccaagtctaataatgttgaatttgctgtgaaccctgatggtgtttatactgagcctcgccccattggcactcgttacctcccccgtaatctgtaattgcttgttaatcaataaaccggttgattcgtttcagttgaactttggtctctgcgaagggcgaattc

SEQ ID NO: 429 - protein, 1458 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLEHPPPQILIKNTPVPANPPEVFTPAKFASFITQYSTGQVSVEIEWELQKENSKRWNPEIQYTSNYAKSNNVEFAVNPDGVYTEPRPIGTRYLTRNLMAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIGSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLLNIQVKEVTTNDGVTTIANNLTSTVQVFSDSEYQLPYVLGSAHQGCLPPFPADVFMIPQYGYLTLDNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 430 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgtttgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgtccagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaggagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccattggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagcctatgggtctcttctttccaggagccgtcttagcgccttcctcaaccagaccgagaggttcgagaacccgcttcttggcctggaagactgctcgcccgaggttgcccccaaatgacgtatcttcttgcagacgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagtcatttattgctcagaaacacagtcgtccaggtccacgttgaccaggtcgcaggccgagcaagcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcacctgaagcatgcccgcgtgacgagaacatttgttttggtacctgtcggcaaagtccaccggagctccttccgcgtctgacgtcgatgggtccgtgactgagggacgggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggttgctggtgctcgaaggtggtgctgttcccgtcgatcacggcgcacatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 431 - DNA, 3095 bp, Adeno-associated virus
gaattcgcccttcgcagagaccaaagttcaactgaaacgaatcaaccggtttattgattaacaagcaattacagattacgggtgaggtaacgagtgccaatggggcgaggctcagtataaacaccatcagggttcacagcaaattcaacattattagacttggcataattggaagtatactgaatttctgggttccagcgcttgctgttttctttctgcagctcccactcgatttccacgctgacttgtccggtgctgtactgcgtgatgaaggaggcaaacttggcaggagtaaacacctccggaggattagcaggtacaggtgtgtttttgatcaggatctgtggaggcgggtgttcgagtccaaaaccgcccatcagaggagacgggtgaaagttgccatccgtgtgaggaattttggcccagatgggaccctgcagatacacgtcccggttctgccagaccatgccaggcagtgctccctggctgttgatagtctgtgattgaggcccggctgtagacgactgcaggttgctggagaccacaccgtattcttctgtagccacagggttagtggtcttgatctcctcctcgctggtcatcagaacgttttccagcgtagttttgttggcagctcccgtcttgccaaaaaccagtaccccgttgatgggaaagaactggtcctcatcatccttgttggttgccatgggaatgccaggattggtcaaagagtttctgccattcagatgatatttagtggcagcagtccaggcaaaattgctgttgttgttaaagtccaagttctttgacagtctctgttgcctatagcagggtccaggcagccagttctttgactgctcggccatagtattgggcccagcttgatgaaattgcagttccctggtggaacccgtggtgctctgggtccgggccaggtagtacaggtactggtcgatgagagggttcatcagccggtctaggctctggctgtgcgcgtagctgctgtggaaaggcacgtcctcgaagctgtaactgaactcaaagttgttgcccgttctcagcatttgagaggggaaatattccaggcagtagaaggaggaacggcccaccgattggctgccgttgttcagagtcaggtagccgtactgaggaatcatgaagacgtccgccgggaacggaggcaggcagccctggtgcgcagagccgaggacgtacggcagctggtattccgagtccgagaagacctgaaccgtgctggtaaggttattagcgatggtcgtgacgccgtcattcgttgtgacctccttgacctggatgttgaagagcttgaaccgcagcttcttgggccggaatccccagttgttgttgatgagtcgctgccagtcacgtggtgagaagtggcagtggaatctgttaaagtcaaaatacccccagggggtgctgtagccgaagtagtggttgtcattggtggctcctgagctgctgctggagatttgcttgtagaggtggttgttgtaggtggggagggcccaggttctggtgctggtggtgatgactctgtcgcccagccatgtggaatcgcaatgccaatttcctgaggcattacccactccgtcggcaccttcgttattgtctgccgttggtgcgccaccgcctgcagccattgtaccagatcccacactagagggcgctgctggaggttctccaagaggttgagggtcggggactgactctgagtcgccagtctgaccaaaattgagcttctttttagcgggctgctggccttttttgccgatgcccgtggaggagtctggagagtctatgggtctcttctttccaggagccgtcttagcgccttcctcaaccagaccgagaggttcgagaacccgcttcttggcctggaagactgctcgcccgaggttgcccccaaatgacgtatcttcttgcaggcgctcctgaaactcggcgtcggcgtggttataccgcaggtacggattgtcacccgctttgagctgctggtcgtaggccttgtcgtgctcgagggccgctgcgtccgccgcgttgacgggctcccccttgtcgagtccgttgaagggtccgaggtacttgtagccaggaagcaccagaccccggccgtcgtcctgcttttgctggttggctttgggtttcggggctccaggtttcaggtcccaccactcgcgaatgccctcagagaggttgtcctcgagccaatctggaagataaccatcggcagccatacctggtttaagccatttattgctcagaaacacagtcgtccaggtccacgttgaccaggtcgcaggccgagcaggcaatctcgggtgcccgccccagcagatgatgaatcgcacacagcttccgatacgtcttttttctgacgaccggttgagattctgacacgccggggaaacattctaaacagtctctgaccccgtgcgtgaagcaaatgttgaaattctgattcattctctcgcacgttttgcagggaaacagcatctgaagcatgcccgcgtggcgagaacatttgttttggtacctgtcggcaaagtccaccggagctccttccgcgtctgacgtcgatgggtccgtgactgagggacaggcccgcttgggctcgcttatatccgcgtcatcgggggcgggtcttttgctggctccgccctttctgacgtagaactcatgcgtcacctcagtcacgtgatcactagcccagcggaagaactctttgacttcctgctttgtcaccttgccaaagtcgtgttccagacggcgggtgagttcaaatttgaacatccggtcctgcaacggctgctggtgctcgaaggtggtgctgttcccgtcgatcacggcgcgcatgttggtgttggaggtgacgatcacgggggtgggatcgatctgggcggacgacttgcacttttggtccacgcgcaccttgctgccgccgagaatggccttggcggactccacgaccttggccgtcatcttgccctcctcccaccagatcaccatcttgtcgacgcaatcgttgaagggaaagttctcattggtccagttgacgcagcaagggcgaattc

SEQ ID NO: 432 - protein, 729 aa, Adeno-associated virus; identical to SEQ ID NO: 160

SEQ ID NO: 433 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 434 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 435 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 436 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 437 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 438 - protein, 738 aa, Adeno-associated virus; identical to SEQ ID NO: 90

SEQ ID NO: 439 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 440 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 441 - DNA, 2211 bp, Adeno-associated virus
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 442 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 443 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcagcgcggcggacgcagcggccctcgagcacgacaaggcctgcgaccagcggctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagggaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaatcacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacgaacagactggtgtggactttgccgttgacagccagggtgtttattctgagcctcgccccattggtactcgttacctcacccgtaatctgtaa

SEQ ID NO: 444 - protein, 737 aa, Adeno-associated virus
MAADGYLPDWLEDNLSEGIREWWDLKPGAPKPKANQQKQDDGRGLVLPGYKYLGPFNGLDKGEPVSAADAAALEHDKACDQRLKAGDNPYLRYNHADAEFQERLQEDTSFGGNLGRAVFQAKKRVLEPLGLVEEAAKTAPGKKGPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDEQTGVDFAVDSQGVYSEPRPIGTRYLTRNL

SEQ ID NO: 445 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcgactcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatccttatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgcttactctgagcctcgccccattggcactcgttacctcacccgtaatctgtaa

SEQ ID NO: 446 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSTQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGAYSEPRPIGTRYLTRNL

SEQ ID NO: 447 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 448 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKATNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 449 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagcacctcggacccttcaacggactcgacaagggggagcccgtcaacgcggcggacgcagcggccctcgagcacgacaaggcctacgaccagcagctcaaagcgggtgacaatccgtacctgcggtataatcacgctgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 450 - protein, 738 aa, Adeno-associated virus
MAADGYLPDWLEDNLSEGIREWWDLKPGAPKPKANQQKQDDGRGLVLPGYKHLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 451 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 452 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 453 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 454 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 455 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 456 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 457 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 458 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 459 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 460 - DNA, 2217 bp, Adeno-associated virus
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 461 - protein, 738 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 462 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 463 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 464 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 465 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 466 - protein, 734 aa, Adeno-associated virus; identical to SEQ ID NO: 291

SEQ ID NO: 467 - DNA, 2214 bp, Adeno-associated virus
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 468 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 469 - DNA, 2214 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 470 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 471 - DNA, 2208 bp, Adeno-associated virus
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcttcaggaaattggcattgcgattcccaatggctgggcgacagagtcatcaccaccagcacccgaacctgggcccagcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggagctcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccgaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 472 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 473 - DNA, 2217 bp, Adeno-associated virus
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 474 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 475 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 476 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 477 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 478 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccctaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 479 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNPTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 480 - DNA, 2208 bp, Adeno-associated virus
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 481 - protein, 735 aa, Adeno-associated virus
MAADGYLPDWLEDNLSEGIHEWWDPKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTHNNHLYKQISNGTSGGSTNDNVYFGYSTPWGYFDFNRFHCHFSPRDRQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTEGTAGTQQLLFSQAGPSNMSAQARNWLPGPCYRQQRVSTTLSQNNNSNFAWTGATKYHLNGRDSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 482 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQDTAPIVGAVNSQGALPGMVWQNRDVYLQGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 483 - DNA, 2217 bp, Adeno-associated virus
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 484 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 485 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 486 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 487 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 488 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 489 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRWNPEIQYTSNYYKSTNVDFAVNTEGVYSEPRPIGTRYLTRNL

SEQ ID NO: 490 - protein, 738 aa, Adeno-associated virus; identical to SEQ ID NO: 488

SEQ ID NO: 491 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctagaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 492 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPRPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 493 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccatgccgacgccgagtttcaggagcgtctgcaagaagatacgtcttttgggggcaacctcgggcgagcagtcctccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 494 - protein, 737 aa, Adeno-associated virus; identical to SEQ ID NO: 453

SEQ ID NO: 495 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVLQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 496 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccacccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggtgatcgagtgggagctgcagaaggagaacagcaagcgctggaacccagagattcagtatacttccaactactacaaatctacaaatgtggactttgctgttaatactgagggtgtttactctgagcttcgccccattggcactcgttacctcacccgtaatctgtaa

SEQ ID NO: 497 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPPSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVVIEWELQKENSKRWNPEIQYTSNYYKSTNVDFAVNTEGVYSELRPIGTRYLTRNL

SEQ ID NO: 498 - DNA, 2214 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgccccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccatcagctacaccttcgaggacgttcccttccacagcagctacgcacacagccagagcctggaccggctgatgaatcctcttatcgaccagtacctgtattacctggccagaacacagagcaacgcaggaggcacagctggcaatcaggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 499 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTISYTFEDVPFHSSYAHSQSLDRLMNPLIDQYLYYLARTQSNAGGTAGNQELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 500 - DNA, 2217 bp, Adeno-associated virus
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccgcctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggatgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgagcggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattcttccatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatttgtaa

SEQ ID NO: 501 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPAYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLSGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSSITQYSTGQVSVEIEWELQKENSKRWNPEIQYTSNYYKSTNVDFAVNTEGVYSEPRPIGTRYLTRNL

SEQ ID NO: 502 - protein, 736 aa, Adeno-associated virus; identical to SEQ ID NO: 2

SEQ ID NO: 503 - DNA, 2217 bp, Adeno-associated virus
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 504 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQRQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 505 - protein, 736 aa, Adeno-associated virus
MAADGYLPDWLEDNLSEGIREWLNLKPGAPQPKANQQKQDNARGLVLPGYKYLGPFNGLDKGDPVNEADAAALEHDKAYGQQLKAGDNPYLKYNHADAEFQERLQKDTSFGGNLGKAVFQAKKRILEPLGLVETPAKTAPGKKRPVDPSPQRSPDSSSGIGKKSPHPARKRLNFGQTGEAESVPDPQPIGEPPSDPSSVGSGTMAAGGGAPMADNNEGADGVGNSSGNWHCDSTWLGDRVITTSTRTWALPTYNNHLYKQISSQSGATNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSKTQGTNATVQGAKLQFSQAGPSNMRDQARNWLPGPCYRQQRVSKTANDNNNSEYAWTGATKYHLNGRDSLVNPGPAMASHKDDEEKFFPMNGTLVFGKNGAGNSNVDIENVMITDEEEIRTTNPVATEQYGVVSDNLQSSNTRPITGDVDSQGVLPGMVWQDRDVYLQGPIWAKIPHTDGHFHPSPLMGGFGLKHPPPQILIKNTPVPANPATTFTPGKFASFITQYSTGQVSVQIEWELQKENSKRWNPEIQYTSNYNKSVNVDFTVDTNGVYSEPRPIGTRYLTRNL

SEQ ID NO: 506 - protein, 736 aa, Adeno-associated virus; identical to SEQ ID NO: 81

SEQ ID NO: 507 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 508 - protein, 736 aa, Artificial Sequence; identical to SEQ ID NO: 507
  Description of Artificial Sequence: Synthetic polypeptide

SEQ ID NO: 509 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQRANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 510 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDAFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 511 - DNA, 1803 bp, Bovine adeno-associated virus
acggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 512 - DNA, 1617 bp, Bovine adeno-associated virus
atgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 513 - DNA, 1173 bp, Bovine adeno-associated virus
atggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 514 - DNA, 1833 bp, Bovine adeno-associated virus
atggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaa

SEQ ID NO: 515 - DNA, 2211 bp, Bovine adeno-associated virus
atgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctag

SEQ ID NO: 516 - DNA, 4694 bp, Bovine adeno-associated virus
gtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccacactctctagcaagggggttttgtaggtggtgatgtcattgttgatgtcattatagttgtcacgcgatagttaatgattaacagtcatgtgatgtgtgttatccaataggatgaaagcgcgcgaatgagatctcgcgagacttccggggtataaaaggggtgagtgaacgagcccgccgccattctctgctctggactgctagaggaccctcgctgccatggctaccttctatgaagtcattgttcgcgttccatttgatgtggaagagcacctgcctggaatttctgacaactttgtagactgggtaactggtcaaatttgggagctgcctcccgagtcagatttgaatttgactctgattgagcagcctcagctgacggtggctgacagaattcgccgcgtgttcctgtacgagtggaacaaattttccaagcaggagagcaaattctttgtgcagtttgaaaagggatctgaatattttcatctgcacacgctcgtggagacctccggcatctcttctatggtccttggccgctacgtgagtcagattcgcgcccagctggtgaaggtggtgttccagaacattgagccgcggattaacgactgggtcgccatcaccaaggtaaagaagggcggagccaataaggtggtggattctgggtatattcccgcctacctgctgccgaaggtccaaccagagcttcagtgggcgtggactaacctcgaagagtataaattggccgccctcaatctggaggagcgcaaacggctcgtcgctcagtttcagcttgagtcctcgcagcgctcgcaagaggcatcttcccagagggacgtttcggctgacccggtcatcaagagcaagacttcccagaaatacatggcgctggtaagctggctggtggaacatggcatcacttccgagaagcagtggattcaggagaatcaggagagctacctgtccttcaactccacgggaaactctcggagccagattaaagccgcgcttgacaacgcgtcaaaaattatgagtctgaccaaatctgcctcagactatctcgtgggacagactgttccagaggacatttctgaaaacagaatctggcagatttttgatctcaacggctacgacccggcatacgcgggctctgttctctacggctggtgcactcgcgcctttggaaagaggaacaccgtctggctgtatggacccgcgaccaccggaaagaccaacatcgcggaagccatctctcacaccgtgcccttttatggctgtgtgaactggactaatgagaactttccctttaatgactgtgtggaaaaaatgttgatctggtgggaggagggaaagatgaccagcaaggtggtggaacccgccaaggccatcttgggggggtctagagtacgagtggatcaaaaatgtaaatcctctgtacaagtagactctaccccggtgattatcacctccaatactaacatgtgtgtggtggtggatgggaactccacgacctttgaacaccagcagccgctggaagaccgcatgttcagatttgaactcatgcggcggctcccgccagattttggcaagattaccaagcaggaagtcaaagacttttttgcttgggcaaaggtcaaccaggtgccggtgactcacgagtttatggttcccaagaaagtggcgggaactgagagggcggagacttctagaaaacgcccactggatgacgtcaccaataccaactataaaagtccggagaagcgggcccggctctcagttgttcctgagacgcctcgcagttcagacgtgcctgtagagcccgctcctctgcgacctctcaactggtcttccaggtatgaatgcagatgtgactatcatgctaaatttgactctgtaacgggggaatgtgacgagtgtgaatatttgaatcggggcaaaaatggctgtatctttcataatgctacacattgtcaaatttgtcacgctgttcctccatgggaaaaggaaaatgtgtcagattttaatgattttgatgactgtaataaagagcagtaaataaagtgagtagtcatgtcttttgttgaccaccctccagattggttggaatcgatcggcgacggctttcgtgaatttctcggccttgaggcgggtcccccgaaacccaaggccaatcaacagaagcaagataacgctcgaggtcttgtgcttcctgggtacaagtatcttggtcctgggaacggccttgataagggcgatcctgtcaattttgctgacgaggttgcccgagagcacgacctctcctaccagaaacagcttgaggcgggcgataacccttacctcaagtacaaccacgcggacgcagagtttcaggagaaactcgcttctgacacttcttttgggggaaaccttgggaaggctgttttccaggctaaaaagaggattctcgaacctcttggcctggttgagacgccggataaaacggcgcctgcggcaaaaaagaggcctctagagcagagtcctcaagagccagactcctcgagcggagttggcaagaaaggcaaacagcctgccagaaagagactcaactttgacgacgaacctggagccggagacgggcctcccccagaaggaccatcttccggagctatgtctactgagactgaaatgcgtgcagcagctggcggaaatggtggcgatgcgggacaaggtgccgagggagtgggtaatgcctccggtgattggcattgcgattccacttggtcagagagccacgtcaccaccacctcaacccgcacctgggtcctgccgacctacaacaaccacctgtacctgcggctcggctcgagcaacgccagcgacaccttcaacggattctccaccccctggggatactttgactttaaccgcttccactgccacttctcgccaagagactggcaaaggctcatcaacaaccactggggactgcgccccaaaagcatgcaagtccgcatcttcaacatccaagttaaggaggtcacgacgtctaacggggagacgaccgtatccaacaacctcaccagcacggtccagatctttgcggacagcacgtacgagctcccgtacgtgatggatgcaggtcaggagggcagcttgcctcctttccccaacgacgtgttcatggtgcctcagtacgggtactgcggactggtaaccggaggcagctctcaaaaccagacagacagaaatgccttctactgtctggagtactttcccagccagatgctgagaaccggaaacaactttgagatggtgtacaagtttgaaaacgtgcccttccactccatgtacgctcacagccagagcctggataggctgatgaacccgctgctggaccagtacctgtgggagctccagtctaccacctctggaggaactctcaaccagggcaattcagccaccaactttgccaagctgaccaaaacaaacttttctggctaccgcaaaaactggctcccggggcccatgatgaagcagcagagattctccaagactgccagtcaaaactacaagattccccagggaagaaacaacagtctgctccattatgagaccagaactaccctcgacggaagatggagcaattttgccccgggaacggccatggcaaccgcagccaacgacgccaccgacttctctcaggcccagctcatctttgcggggcccaacatcaccggcaacaccaccacagatgccaataacctgatgttcacttcagaagatgaacttagggccaccaacccccgggacactgacctgtttggccacctggcaaccaaccagcaaaacgccaccaccgttcctaccgtagacgacgtggacggagtcggcgtgtacccgggaatggtgtggcaggacagagacatttactaccaagggcccatttgggccaaaattccacacacggatggacactttcacccgtctcctctcattggcggatttggactgaaaagcccgcctccacaaatattcatcaaaaacactcctgtacccgccaatcccgcaacgaccttctctccggccagaatcaacagcttcatcacccagtacagcaccggacaggtggctgtcaaaatagaatgggaaatccagaaggagcggtccaagagatggaacccagaggtccagttcacgtccaactacggagcacaggactcgcttctctgggctcccgacaacgccggagcctacaaagagcccagggccattggatcccgatacctcaccaaccacctctagcccaattctgttgcataccctcaataaaccgtgtattcgtttcagtaaaatactgcctcttgtggtcattcggcgtacaacagcttacaacaacaacaaaacccccttgctagagagtgtggcactcccccccctgtcgcgttcgctcgttcgctggctcgattgggggggtggcagctcaaagagctgccagacgacggccctctgggccgtcgcccccccaatcgagccagcgaacgagcgaacgcgacaggggggggagtgccac

SEQ ID NO: 517 - protein, 390 aa, Bovine adeno-associated virus
MALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 518 - protein, 610 aa, Bovine adeno-associated virus
MATFYEVIVRVPFDVEEHLPGISDNFVDWVTGQIWELPPESDLNLTLIEQPQLTVADRIRRVFLYEWNKFSKQESKFFVQFEKGSEYFHLHTLVETSGISSMVLGRYVSQIRAQLVKVVFQNIEPRINDWVAITKVKKGGANKVVDSGYIPAYLLPKVQPELQWAWTNLEEYKLAALNLEERKRLVAQFQLESSQRSQEASSQRDVSADPVIKSKTSQKYMALVSWLVEHGITSEKQWIQENQESYLSFNSTGNSRSQIKAALDNASKIMSLTKSASDYLVGQTVPEDISENRIWQIFDLNGYDPAYAGSVLYGWCTRAFGKRNTVWLYGPATTGKTNIAEAISHTVPFYGCVNWTNENFPFNDCVEKMLIWWEEGKMTSKVVEPAKAILGGSRVRVDQKCKSSVQVDSTPVIITSNTNMCVVVDGNSTTFEHQQPLEDRMFRFELMRRLPPDFGKITKQEVKDFFAWAKVNQVPVTHEFMVPKKVAGTERAETSRKRPLDDVTNTNYKSPEKRARLSVVPETPRSSDVPVEPAPLRPLNWSSRYECRCDYHAKFDSVTGECDECEYLNRGKNGCIFHNATHCQICHAVPPWEKENVSDFNDFDDCNKEQ

SEQ ID NO: 519 - protein, 538 aa, Bovine adeno-associated virus
MRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 520 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVHIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTNKNFSGYRKNWLPGPMMKQQRFSKTASQNYKIPQGGNNSLLHYETRTTLDRRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 521 - protein, 736 aa, Artificial Sequence
  Description of Artificial Sequence: Synthetic polypeptide
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 522 - protein, 736 aa, Bovine adeno-associated virus; identical to SEQ ID NO: 521

SEQ ID NO: 523 - protein, 600 aa, Bovine adeno-associated virus
TAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 524 - DNA, 2214 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctcctcgggcatcggcaagacaggccagcagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataaccttaccagcacggtccaggtcttcacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacaaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtttggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccaccccattggcacccgttacctcacccgtcccctgtaa

SEQ ID NO: 525 - protein, 737 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRLLEPLGLVEEAAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 526 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 527 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLQGDTSFGGNLGRAVFQAKKRVLEPLGLVEEGAKTAPGKKRPVEQSPQEPDSSSGIGETGQQPAKKRLNFGQTGDSESVPDPQPLGEPPATPAAVGPTTMASGGGAPMADNNEGADGVGSSSGNWHCDSQWLGDRVITTSTRTWALPTYNNHLYKQISSASTGASNDNHYFGYSTPWGYFDFNRFHCHFSPRDWQRLINNNWGFRPKRLSFKLFNIQVKEVTDNNGVKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDKERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPHPIGTRYLTRPL

SEQ ID NO: 528 - DNA, 2181 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcacaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgcacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactattggggcttcagaccccggtctctcagagtcaaaatcttcaacatccaagtcaaagaggtcacggtgcaggactccaccaccaccatcgccaacaacctcacctccaccgtccaagtgtttacggacgacgactaccaactcccgtacgtcgtcggcaacgggaccgagggatgcctgccggccttccccccgcaggtctttacgctgccgcagtacggctacgcgacgctgaaccgagacaacggagacaacccgacagagcggagcagcttcttttgcctagagtactttcccagcaagatgctgaggacgggcaacaactttgagtttacctacagctttgaagaggtgcccttccactgcagcttcgccccgagccagaacctctttaagctggccaacccgctggtggaccagtacctgtaccgcttcgtgagcacctcggccacgggcgccatccagttccaaaagaacctggcgggcagatacgccaacacctacaaaaactggttcccggggcccatgggccgaacccagggctggaacacgagctctggggtcagcagcaccaacagagtcagcgtcaacaacttttccgtctcaaaccggatgaacctggagggggccagctaccaagtgaacccccagcccaacgggatgacaaacacgctccaaggcagcaaccgctacgcgctggaaaacaccatgatcttcaacgctcaaaacgccacgccgggaactacctcggtgtacccagaggacaatctactgctgaccagcgagagcgagactcagcccgtcaaccgggtggcttacaacacgggcggtcagatggccaccaacgcccagaacgccaccacggctcccacggtcgggacctacaacctccaggaagtgcttcctggcagcgtatggatggagagggacgtgtacctccaaggacccatctgggccaagatcccagagacgggggcgcactttcacccctctccggccatgggcggattcggactcaaacacccgccgcccatgatgctcatcaaaaacacgccggtgcccggcaacatcaccagcttctcggacgtgcccgtcagcagcttcatcacccagtacagcaccgggcaggtcaccgtggagatggaatgggagctcaaaaaggaaaactccaagaggtggaacccagagatccagtacaccaacaactacaacgacccccagtttgtggactttgctccagacggctccggcgaatacagaaccaccagagccatcggaacccgatacctcacccgacccctt

SEQ ID NO: 529 - protein, 726 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGDNPTERSSFFCLEYFPSKMLRTGNNFEFTYSFEEVPFHCSFAPSQNLFKLANPLVDQYLYRFVSTSATGAIQFQKNLAGRYANTYKNWFPGPMGRTQGWNTSSGSSTNRVSVNNFSVSNRMNLEGASYQVNPQPNGMTNTLQGSNRYALENTMIFNAQNATPGTTSVYPEDNLLLTSESETQPVNRVAYNTGGQMATNAQNATTAPTVGTYNLQEVLPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDGSGEYRTTRAIGTRYLTRPL

SEQ ID NO: 530 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKSGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 531 - DNA, 1797 bp, Artificial Sequence
  Description of Artificial Sequence: Synthetic polynucleotide
acggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 532 - DNA, 1989 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 533 - DNA, 1626 bp, Artificial Sequence
  Description of Artificial Sequence: Synthetic polynucleotide
atgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 534 - DNA, 1323 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataa

SEQ ID NO: 535 - DNA, 960 bp, Artificial Sequence
  Description of Artificial Sequence: Synthetic polynucleotide
atggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccagattggttggagcggttggtcaaaaagggagtgaatgctgcagctga

SEQ ID NO: 536 - DNA, 1608 bp, Artificial Sequence
  Description of Artificial Sequence: Synthetic polynucleotide
atggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 537 - DNA, 2232 bp, Artificial Sequence
  Description of Artificial Sequence: Synthetic polynucleotide
atgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaa

SEQ ID NO: 538 - protein, 535 aa, Artificial Sequence
  Description of Artificial Sequence: Synthetic polypeptide
MAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 539 - protein, 440 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 540 - protein, 319 aa, Artificial Sequence
  Description of Artificial Sequence: Synthetic polypeptide
MELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 541 - protein, 662 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRYRIKCSKHCGMDKMLFPCQICESMNRDINICAIHKTTDCKECFPDYGDKDDVELPPCTEHNVSRCYQCHSGELYRVTSDSDEKPAPESDEGTEPSYAPCTIHHLMGKSHGLVTCAACRLKNSTLHDDLDDGDLEQ

SEQ ID NO: 542 - protein, 541 aa, Artificial Sequence
  Description of Artificial Sequence: Synthetic polypeptide
MRSYYEVIVQLPNDVESQVPGISDSFVNWITSREWTLPEDADWDLDQVDQVQLTLGDKIQREIRTHWGTMAKEPDFHYFIQLEQGEVFFHLHVLLETCSVKPMVLGRYIRHIQQKIVSKVYCATSLRWKDGCVVTKTKNFGGANKVRAESYIPAYLIPKQQPEVQWAWTNVPEYIKACLHRELRASLARLHFEEAGVSQSKENLARTADGAPVMPTRVSKRYMELVDWLVEKGITTEKEWLLENRESFRSFQASSNSARQIKTALQGAIQEMLLTKTAEDYLVGKDPVSDDDIRQNRIYKILELNHYDPAYVGSILVGWCQKKWGKRNTLWLFGHATTGKTNIAEAIAHAVPFYGCVNWTNENFPFNDCVEKMIIWWEEGKMTAKVVETAKAILGGSRVRVDQKCKASVPIEPTPVIITSNTNMCYVIDGNTTTFEHKQPLEDRMFKLELLTRLPDDFGKVTKQEVRQFFRWSQDHLTPVIPEFLVRKAESRKRPAPSGEGYISPTKRPALAEQQQASESADPVPTRLVGAVGQKGSECCS

SEQ ID NO: 543 - protein, 743 aa, Artificial Sequence
  Description of Artificial Sequence: Synthetic polypeptide
MSLISDAIPDWLERLVKKGVNAAADFYHLESGPPRPKANQQTQESLEKDDSRGLVFPGYNYLGPFNGLDKGEPVNEADAAALEHDKAYDLEIKDGHNPYFEYNEADRRFQERLKDDTSFGGNLGKAIFQAKKRVLEPFGLVEDSKTAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 544 - protein, 598 aa, Artificial Sequence
  Description of Artificial Sequence: Synthetic polypeptide
TAPTGDKRKGEDEPRLPDTSSQTPKKNKKPRKERPSGGAEDPGEGTSSNAGAAAPASSVGSSIMAEGGGGPVGDAGQGADGVGNSSGNWHCDSQWLENGVVTRTTRTWVLPSYNNHLYKRIQGPSGGDNNNKFFGFSTPWGYFDYNRFHCHFSPRDWQRLINNNWGIRPKAMRFRLFNIQVKEVTVQDFNTTIGNNLTSTVQVFADKDYQLPYVLGSATEGTFPPFPADIYTIPQYGYCTLNYNNEAVDRSAFYCLDYFPSDMLRTGNNFEFTYTFEDVPFHSMFAHNQTLDRLMNPLVDQYLWAFSSVSQAGSSGRALHYSRATKTNMAAQYRNWLPGPFFRDQQIFTGASNITKNNVFSVWEKGKQWELDNRTNLMQPGPAAATTFSGEPDRQAMQNTLAFSRTVYDQTTATTDRNQILITNEDEIRPTNSVGIDAWGAVPTNNQSIVTPGTRAAVNNQGALPGMVWQNRDIYPTGTHLAKIPDTDNHFHPSPLIGRFGCKHPPPQIFIKNTPVPANPSETFQTAKVASFINQYSTGQCTVEIFWELKKETSKRWNPEIQFTSNFGNAADIQFAVSDTGSYSEPRPIGTRYLTKPL

SEQ ID NO: 545 - DNA, 4694 bp, Artificial Sequence
  Description of Artificial Sequence: Synthetic polynucleotide
tggccagtttccaagacaggctcgctcgctcactcgggccggggccccaaaggggcccctagcgaccgcttcgcggtcgcggcccgagtgagcgagcgagcctgtcttggaaactggccagcactccggtgaggtaatgccgtcacgtggtcgggaatgggaacgggaaatctcgcgagaacgtaaacaaatataagacggcgccacacggcgctgcgtcatacgcgcgcgcgcaccggcgagatgaggtcgtactacgaggtcatcgttcagctgcccaacgacgtcgagagtcaggtacctggaatctccgattcgttcgtcaactggattacgtcgcgagaatggacgttgcctgaggacgccgattgggatttggaccaggtcgatcaagttcaactgacgctcggcgacaaaatccaacgggagattcgaactcattgggggacgatggccaaagaaccggactttcactattttatccaactggaacaaggtgaggtgttctttcatttacacgtcctgctggaaacgtgttccgtaaagccgatggtactcggaagatatatccgacatattcaacaaaaaattgtgagtaaagtctactgcgccacgagcctacgatggaaggatggatgcgtggtgaccaagaccaaaaatttcgggggcgcgaacaaggtccgggccgagtcgtatattcccgcctacctgatcccgaaacagcaaccggaagtgcagtgggcgtggactaacgtgcccgagtatataaaagcgtgcttgcaccgagaactgcgtgccagtctcgcgcgacttcacttcgaggaggcgggcgtctcgcaatccaaggaaaatctcgcgagaactgcagacggcgctcccgtgatgccgacccgcgtcagcaaacgctacatggagctcgtggattggctcgtggagaaggggatcaccaccgagaaggaatggctgctggaaaacagagaaagctttcggagctttcaggcctcgagcaactcggcgcgtcagatcaagacggccctgcaaggcgccattcaggagatgcttctgaccaagacggcggaggactacctcgtcggaaaggatcccgtctcggacgacgacatccgtcagaaccgcatctacaagattctggaactgaaccactacgacccagcgtacgtggggagtattttggtcgggtggtgccagaagaaatggggcaagcgaaacacgctgtggctgttcggacatgcgaccaccggcaagaccaacatcgcggaggctattgcccatgctgtgccgttctatggatgcgttaactggaccaacgagaactttccgttcaacgactgcgtcgaaaaaatgattatctggtgggaggagggcaaaatgaccgccaaagtggtggaaacagccaaggcgattctgggaggatctcgggtgagagtggaccaaaaatgcaaagcttcggttccgatcgaaccgacgccggtcattattaccagtaacaccaacatgtgttatgtcatcgacgggaacacgaccacgttcgagcataagcagccgttggaggacaggatgtttaagctcgaattgctgactcggttgcctgatgactttggtaaggtgaccaaacaggaggtgcgtcaattcttcaggtggtctcaggatcacctgacccctgtgatcccagaattcctagtgcggaaggcggagtctcgcaaaagacccgccccttccggggaaggctatataagcccgacaaagcggcccgcgctcgcagagcagcagcaggcgtcggagagcgcggacccggttcccaccaggtatcgtatcaaatgctcgaaacattgcggtatggataaaatgttgtttccttgccaaatttgtgaatcgatgaacagagatattaatatttgtgctattcataaaacgaccgactgtaaagagtgtttccccgactacggggataaagatgatgtagaactacccccctgtacagaacacaacgtgtctcgttgttatcaatgtcattcgggcgaattgtatcgcgtgacttcggactctgacgagaaacctgcccccgagagtgatgaaggcaccgagccatcctatgctccctgcacgattcaccacctgatgggcaagagtcacgggttagtcacttgcgcggcgtgtcggttgaaaaatagtacgttgcatgatgacttggatgacggtgatctcgaacaataaatgattgaaatgtagccatgtctctcatttctgatgcgattccagattggttggagcggttggtcaaaaagggagtgaatgctgcagctgatttctaccatttggaaagcggtcctcctcgtcctaaggcaaatcagcaaactcaagaatctcttgaaaaggacgattcgagaggtctcgtgttcccaggctacaattatctaggccctttcaacggtctagataaaggagaacccgtcaacgaggcagacgctgccgccttagaacacgacaaggcttacgacctcgaaatcaaggacgggcacaacccgtactttgagtacaacgaggccgacagacgtttccaggaacgtctcaaagacgatacctcctttggaggcaatttaggtaaagccatcttccaggccaaaaagagggttctcgaaccctttggtctggtggaagactcaaagacggctccgaccggagacaagcggaaaggcgaagacgaacctcgtttgcccgacacttcttcacagactcccaagaaaaacaagaagcctcgcaaggaaagaccttccggcggggcagaagatccgggcgaaggcacctcttccaacgctggagcagcagcacccgcctctagtgtgggatcatctatcatggctgaaggaggtggcggcccagtgggcgatgcaggccagggtgccgatggagtgggcaattcctccggaaattggcattgcgattcccaatggctggaaaacggagtcgtcactcgaaccacccgaacctgggtcttgcccagctacaacaaccacctgtacaaacgaatccaaggacccagcggaggcgacaacaacaacaaattctttggattcagcaccccctggggatactttgactacaatcgattccactgccacttttccccgcgagactggcaacgactcatcaacaacaactggggcatccgtcccaaagcgatgcgctttagactctttaacatccaggttaaagaggtcacggtccaagacttcaacaccaccatcggcaacaacctcaccagtacggtccaggtctttgcggacaaggactaccaactgccgtacgtcctcggatcggctaccgaaggcaccttcccgccgttcccagcggatatctacacgatcccgcagtacgggtactgcacgctaaactacaacaacgaggcggtggatcgttcggccttctactgtctggactactttccctcagacatgctgcggacaggaaataactttgagtttacttacaccttcgaggacgttcctttccatagcatgtttgcccacaaccagacgctagaccggctgatgaatcccctcgtggatcagtacctctgggctttcagctccgtcagccaagcaggctcatctggacgagctcttcattactcgcgggcgactaaaaccaacatggcggctcaatataggaactggttacctgggcctttcttccgtgatcagcaaatctttacgggcgctagcaacatcactaaaaataacgtctttagcgtttgggaaaaaggcaagcaatgggaactcgacaatcggaccaacctaatgcagcccggtcctgcggcagcgaccacctttagcggagaacctgaccgtcaagccatgcaaaacacgctggcttttagcaggaccgtctacgatcaaacgaccgccacgaccgatcgtaaccagatactcatcaccaacgaagacgaaatcagacccaccaactcggtcggtatcgacgcgtggggagcagttcccaccaacaaccagtcgatcgtgacccccggcactcgcgcggccgtcaacaatcaaggggcgcttcccgggatggtgtggcaaaacagagacatttaccctacagggacccatttggccaaaattcccgacactgacaatcacttccatccgtccccgcttattgggcggtttggctgcaagcatccccctccccagattttcattaaaaacacacccgtccctgccaacccttcggaaacgttccagacggccaaagtggcctccttcatcaaccagtactcgaccggacagtgcaccgtcgaaatcttttgggaactcaagaaggaaacctccaagcgctggaaccccgaaatccagttcacctccaactttggcaacgcggccgacatccagtttgccgtctccgacacgggatcctattccgaacctcgtcccatcggtacccgttaccttaccaaacctctgtaaattaaacccttcaataaaccgtttatgcgtaactgtatttccgtctcctgtcgttattcagtcacatgatgcggcattacctcaccggagtgctggccagtttccaagacaggctcgctcgctcactcgggccggggccccaaaggggcccctagcgaccgcttcgcggtcgcggcccgagtgagcgagcgagcctgtcttggaaactggcca

SEQ ID NO: 546 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttacctcacccgtcccctgtaa

SEQ ID NO: 547 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 548 - DNA, 2211 bp, Artificial Sequence
  Description of Artificial Sequence: Synthetic polynucleotide
atggcttccgatggttatcttccagattggctcgaggacaacctctctgagggcatccgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcagagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcccatttgggccaaaattcctcacacagatggacactttcacccgtctcctcttatgggcggctttggacttaagcacccgcctcctcagatcctcatcaaaaacacgcctgttcctgcgaatcctccggcagagttttcggctacaaagtttgcttcattcatcacccagtattctactggccaagtcagcgtggagattgaatgggagctgcagaaagaaaacagcaaacgctggaatcccgaagtgcagtatacatctaactatgcaaaatctgccaacgttgatttcactgtggacaacaatggactttatactgagcctcgtcccattggcacccgttacctcacccgtcccctgtaa

SEQ ID NO: 549 - protein, 736 aa, Artificial Sequence
  Description of Artificial Sequence: Synthetic polypeptide
MASDGYLPDWLEDNLSEGIREWWDLKPGAPKPKANQQKQDDGRGLVLPGYKYLGPFNGLDKGEPVNAADAAALEHDKAYDQQLRAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 550 - DNA, 2211 bp, Artificial Sequence
  Description of Artificial Sequence: Synthetic polynucleotide
atggctgctgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgcagcggccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagagactcaattttggtcagactggcgactcagagtcagtccccgacccacaacctctcggagaacctccagcaacccccgctgctgtgggacctactacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcagactatcagctcccgtacgtgctcgggtcggctcacgagggctgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacctgaacagaactcagaatcagtccggaagtgcccaaaacaaggacttgctgtttagccgggggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggactcaagaacccgcctcctcagatcctcatcaaaaacacgcctgttcctgcgaatcctccggcggagttttcagctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 551 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSDYQLPYVLGSAHEGCLPPFPADVFMVPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 552 - DNA, 2211 bp, Artificial Sequence
  Description of Artificial Sequence: Synthetic polynucleotide
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcaatcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacataaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaaacgctggaatcccgaagtgcagtatacatctaactatgcaaaatctgccaacattgatttcactgtggacaacaatggactttatactgagcctcgccccattggcacccgttacctcacccgtccccagtaa

SEQ ID NO: 553 - protein, 736 aa, Artificial Sequence
  Description of Artificial Sequence: Synthetic polypeptide
MAADGYLPDWLEDNLSEGIREWWALKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANIDFTVDNNGLYTEPRPIGTRYLTRPQ

SEQ ID NO: 554 - DNA, 2211 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtaccttcggtataaccacgccgacgccgagtttcaggagcgtctgcaagaagatacgtcttttgggggcaacctcgggcgagcagtcttccaggccaaaaagagggttctcgaacctctcggtctggttgaggaagcggctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctcccgcagccccctcaggtgtgggatctcttacaatggcttcaggtggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaacaactttaccttcagctacacctttgaggaagtgcctttccacagcagctacgcgcacagccagagcctggaccggctgatgaatcctctcatcgaccagtacctgtattacctgaacagaactcaaaatcagtccggaagtgcccaaaacaaggacttgctgtttagccgtgggtctccagctggcatgtctgttcagcccaaaaactggctacctggaccctgttaccggcagcagtgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagcgtggagattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctcacccgtcccctgtaa

SEQ ID NO: 555 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEQSPQEPDSSSGIGKTGQQPAKKRLNFGQTGDSESVPDPQPLGEPPAAPSGVGSLTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQCVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 556 - DNA, 2211 bp, Artificial Sequence
  Description of Artificial Sequence: Synthetic polynucleotide
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgacttcaacagattccactgccacttttcaccacgtgactggcaaagactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttaccttcagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagaggaaatcaaagccactaaccccgtggccactgaaagatttgggactgtggcagtcaatctccagagcagcagcacagaccctgcgaccggagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 557 - protein, 736 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNLQSSSTDPATGDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 558 - DNA, 2208 bp, Artificial Sequence
  Description of Artificial Sequence: Synthetic polynucleotide
  modified_base (955)..(955): a, c, t, g, unknown or other
  modified_base (971)..(972): a, c, t, g, unknown or other
  modified_base (981)..(981): a, c, t, g, unknown or other
  modified_base (986)..(986): a, c, t, g, unknown or other
  modified_base (1235)..(1235): a, c, t, g, unknown or other
  modified_base (1694)..(1696): a, c, t, g, unknown or other
  modified_base (1698)..(1698): a, c, t, g, unknown or other
  modified_base (1763)..(1765): a, c, t, g, unknown or other
  modified_base (1778)..(1778): a, c, t, g, unknown or other
  modified_base (2204)..(2204): a, c, t, g, unknown or other
atggctgccgatggttatcttccagattggctcgaggacaacctctctgagggcattcgcgaatggtgggacttgaaacctggagccccgaaacccaaagtcaaccagcaaaagcaggacaacgctcggggtcttgtgcttccgggttacaaatacctcggacccttcaacggactcgacaagggggagcccgtcaacgcggcggacgcagcggccctcgagcacgacaaggcctacgaccagcagctcaaagcgggtgacaatccgtaccttcggtataaccacgccgacgccgagtttcaggagcgtctgcaagaagatacgtcttttgggggcaaccttggacgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccacttttcaccacgtgactggcagcgactcatcaataacaattggggattccggcccaagagactcaacttcaaactcttcaacntccaagtcaaggaggnnacgacgaangatgncgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaggcagtgggacggtcatccttttactgcctggaatatttcccatcgcagatgctgagaacgggcaataactttacctncagctacacttttgaggacgttcctttccacagcagctacgctcacagccagagcctggaccggctgatgaatcctctcatcgaccagtacctgtattacctgaacagaactcagaatcagtccggaagtgcccaaaacaaggacttgctgtttagccgtgggtctccaactggcatgtctgttcagcccaaaaactggctacctggaccctgttatcggcagcagcgcgtttctaaaacaaaaacagacaacaacaacagcaactttacctggactggtgcttcaaaatataaccttaatgggcgtgaatctataatcaaccctggcactgctatggcctcacacaaagacgacgaagacaagttctttcccatgagcggtgtcatgatttttggaaaggagagcgccggagcttcaaacactgcattggacaatgtcatgatcacagacgaagagannncnaagccactaaccccgtggccactgaaagatttgggactgtggcagtcaatctccaagcagcacannnaccctgcgaccgnagatgtgcatgccatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtccccngtaa

SEQ ID NO: 559 - protein, 723 aa, Artificial Sequence
  Description of Artificial Sequence: Synthetic polypeptide
MAADGYLPDWLEDNLSEGIREWWDLKPGAPKPKVNQQKQDNARGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNQVKETTDVTTIANNLTSTVQVFSDSEYQLPYVLGSAHQGCLPPFPADVFMIPQYGYLTLNNGSQAVGRSSFYCLEYFPSQMLRTGNNFTSYTFEDVPFHSSYAHSQSLDRLMNPLIDQYLYYLNRTQNQSGSAQNKDLLFSRGSPTGMSVQPKNWLPGPCYRQQRVSKTKTDNNNSNFTWTGASKYNLNGRESIINPGTAMASHKDDEDKFFPMSGVMIFGKESAGASNTALDNVMITDEEATNPVATERFGTVAVNLQSSPATDVHAMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRP

SEQ ID NO: 560 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggtcagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacgctccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 561 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDAPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 562 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcaaactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcgggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacgaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtatacagagcctcgccccattggcaccagatacctgactcgtaatctgtaa

SEQ ID NO: 563 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDANSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSRAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYTEPRPIGTRYLTRNL

SEQ ID NO: 564 - DNA, 2211 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcgacgggggccagcaacgacaaccactacttcggctacagcaccccctgggggtattttgactttaacagattccactgccacttttcaccacgtgactggcagcgactcatcaacaataactggggattccggcccaagagactcagcttcaagctcttcaacatccaggtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgatcaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcactcaatactccacaggacaagtgagcgtggaaattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 565 - protein, 736 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLSFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 566 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRNQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNQ

SEQ ID NO: 567 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggaacgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcggaaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatcagtaa

SEQ ID NO: 568 - DNA, 2208 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctatgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgatccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaagttcaagctctttaacattcaagtcaaagaggtcacgcagaatgacggtacgacgacgattgccaataaccttaccagcacggttcaggtgtttactgactcggagtaccagctcccgtatgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggtaacaactttaccttcagctacacttttgaggacgttcctttccacagcagctacgctcacagccagagtctggaccgtctcatgaatcctctcatcgaccagtacctgtattacttgagcagaacagacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaagtgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaagttcagtacacttccaactacaacaagtctgttaatgtggactttactgtggacactaatggcgtgtattcagagcctcgccccattggcaccagatacctgactcgtaatctgtaa

SEQ ID NO: 569 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLKFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTDTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTSVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEVQYTSNYNKSVNVDFTVDTNGVYSEPRPIGTRYLTRNL

SEQ ID NO: 570 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatgactgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcaactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 571 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggggcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactggaggtgtatatagtgaaccccgccccattggcaccagatacctgactcgtaatctgtaattgcttgttaatcaataaaccgtttaattcgtttcagttgaactgcggcc

SEQ ID NO: 572 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggactcggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattgacaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcggactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 573 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcctccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggatccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccaggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 574 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacagggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaagaaaaacagcaagcgctggaacccggagatccagtacacttccaactattacaagtctaataatgttgaatttgctgttaacactgaaggtgtatatagtgaaccccgccccattggcaccagatacctgactcgtaatctgtaattgcttgttaatcaataaaccgtttaattcgtttcagttgaactgcggcc

SEQ ID NO: 575 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacgggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 576 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagtagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggatttcggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 577 - DNA, 2580 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcgggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggaactgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaatt

SEQ ID NO: 578 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtctttcaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcatgtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 579 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccgatcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgtacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 580 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgccacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgctgccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacatgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcaatgtggccggacccagcaacatggctgtccagggaagaaactacatacctggacccagctaccgacaacaacgtgtctcaaccactgtgactcaaaacaacaacagcgaatttgcctggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcatggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 581 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 582 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagcggcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 583 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcgcggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 584 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgactgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaaattgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccagtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattgcaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 585 - DNA, 2601 bp, Artificial Sequence
  Description of Artificial Sequence: Synthetic polynucleotide
ccatcgacgtcagacgcggaagcttcgatcaactacgcggacaggtaccaaaacaaatgttctcgtcacgtgggcatgaatctgatgctgtttccctgcagacaatgcgagagactgaatcagaattcaaatatctgcttcactcacggtgtcaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggacttggatgtctgtgtttctgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgataagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctagagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactgcggcc

SEQ ID NO: 586 - protein, 736 aa, Artificial Sequence
  Description of Artificial Sequence: Synthetic polypeptide
MTADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKQLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 587 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTGGVYSEPRPIGTRYLTRNL

SEQ ID NO: 588 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIDKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 589 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVLQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGSSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 590 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDRAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKKNSKRWNPEIQYTSNYYKSNNVEFAVNTEGVYSEPRPIGTRYLTRNL

SEQ ID NO: 591 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQARAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 592 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAVDAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 593 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPREPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 594 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASCGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 595 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPINAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTYGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 596 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPHDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFNVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSMEIEWELQKENSKRWNPEIQYTSNYYKSNNVEFAVNTEGVYSEPRPIGTRYLTRNL

SEQ ID NO: 597 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 598 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWERQKENSKRWNPEIQYTSNYYKSNNVEFAVNTEGVYSEPRPIGTRYLTRNL

SEQ ID NO: 599 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFADSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 600 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEIAWPRASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYCKSNNVEFAVNTEGVYSEPRPIGTRYLTRNL

SEQ ID NO: 601 - protein, 736 aa, Artificial Sequence; identical to SEQ ID NO: 597
  Description of Artificial Sequence: Synthetic polypeptide

SEQ ID NO: 602 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcggctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctgggacccggagatccagtacacttccaactattacaagtctaataatgttgaatttgctgttaatactgaaggtgtatatagtgaaccccgccccattggcaccagatacctgactcgtaatctg

SEQ ID NO: 603 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccgcttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacgcccctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 604 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcagcgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccgcgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 605 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacacggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 606 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcggctcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtagcaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggcagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagcacacttccaactattacaagtctaataatgttgaatttgctgttaatactgaaggtgtatatagtgaaccccgccccattggcaccagatacctgactcgtaatctg

SEQ ID NO: 607 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaggctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaagccaaggaatacttccgggtatggtttggcaggacagagatgtgtacctgcaaggacccatttgggccaaaattcctcacacggacggcaactttcacccttctccgctgatgggagggtttggaatgaagcacccgcctccccagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 608 - DNA, 2205 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgcccgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctggaggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggccttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacgagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 609 - DNA, 2205 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggacaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccaattcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 610 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagccatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgacaaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 611 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaatgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccagaccaaaaagaggcttcttgaacctcttggtctggttgaggaagcggctaagacggctcctggaaagaagaggcctgtagagcagtctcctcaggaaccgggctcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 612 - DNA, 2208 bp, Artificial Sequence
  Description of Artificial Sequence: Synthetic polynucleotide
atggctgccgatggttattttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaatctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatctcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctgtggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 613 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagcggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 614 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcggggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtccggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcggcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 615 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacctgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 616 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaagaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 617 - DNA, 2208 bp, Artificial Sequence
  Description of Artificial Sequence: Synthetic polynucleotide
  modified_base (1325)..(1325): a, c, t, g, unknown or other
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaccagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccnatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccggatatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 618 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgcactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagctacaaagaaggagaggacagtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagaccctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 619 - DNA, 2208 bp, Artificial Sequence; identical to SEQ ID NO: 602
  Description of Artificial Sequence: Synthetic polynucleotide

SEQ ID NO: 620 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccagggcaaatcaacaacatcaagacaacgctcgaggtcttgtgcttccgggttacaaataccttggacccggcaacggactcgacaagggggagccggtcaacgcagccgacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactgtcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaacgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcccatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 621 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaagaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccacccatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatggtgaaccccgccccattggcaccagatacctgactcgtaatctg

SEQ ID NO: 622 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgaccggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 623 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcagccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcaattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccggcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaagaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 624 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacagataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggtaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtatcggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccgtcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtggaccccgccccattggcaccagatacctgactcgtaatctg

SEQ ID NO: 625 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 626 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacgtcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggaggcaacccgtgcctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcagatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaaggccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattgacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatggatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacgggcggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 627 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagcctaataatgttgaatttgctgttaatactgaaggtgtatatagtgaaccccgccccattggcaccagatacctgactcgtaatctg

SEQ ID NO: 628 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcctcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctactatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 629 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgtgcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcacgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattgggccccgatacctgactcgtaatttt

SEQ ID NO: 630 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacaacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgagatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 631 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggcggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcgagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtccagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgcctcaaccactgtgactcaaaacaacaacagcgaatttgcttggcctggagcttcttcttgggctctcaatggacgtaatagcttgatgaatcctggacctgctatggccagccacaaagaaggggaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 632 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagcccccccaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattagcggttctggacagaatcaacaaacgctaaaattcagtgtggccggacccagcaacatggctgtccagggaagaaactacatacctggacccagctaccgacaacaacgtgtctcaaccactgtgactcaaaacaacagcagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatactttcgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 633 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 634 - DNA, 2208 bp, Artificial Sequence; identical to SEQ ID NO: 633
  Description of Artificial Sequence: Synthetic polynucleotide

SEQ ID NO: 635 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtgcaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcgactacagcaccccctgggggtattttgacttcaacagattccactgccacttctcaccacgtgactggcagcggctcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcagggcagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 636 - DNA, 2208 bp, Artificial Sequence; identical to SEQ ID NO: 633
  Description of Artificial Sequence: Synthetic polynucleotide

SEQ ID NO: 637 - DNA, 2208 bp, Artificial Sequence
  Description of Artificial Sequence: Synthetic polynucleotide
atggctgccgatggttatcctccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggggacaacccgcacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcccgtagagcagtctcctcaggaaccggactcctccgcgggtattggcaaatcgggtgcacagcccgctaagaagagactcaatttcggtcagactggcgacactgagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaggctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 638 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcggacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagtttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 639 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacttacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcaccaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatatcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 640 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagtttagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttctggcaaacaaggaactggaagagacaacgtggatgcgaacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttgaaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 641 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatagcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcgaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagcttttcaacattcgggtcaaagaggttacggacaacaatggagtcaagaccatcaccaataaccttaccagcacggtccaggtcttcacggactcagactatcagctcccgtacgtgcttgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcgaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 642 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggcgcacagcccgctaaaaagagactcaatttcggtcagactggcgacacagagccagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcgggcgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgcgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 643 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgggttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagtccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggagctggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 644 - DNA, 2208 bp, Artificial Sequence
  Description of Artificial Sequence: Synthetic polynucleotide
  modified_base (377)..(377): a, c, t, g, unknown or other
atggctgccgatggttatcttccagattggctcgaggacaaccttagtgaaggaattcgcgagaggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcntgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcggggaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcccggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggagtgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 645 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacctcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctg

SEQ ID NO: 646 - DNA, 2208 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccagagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctggactctttcatcacccagtattctactggccaagtcagcgtggagatcgagtgggagctgcagaaggaaaacagcaagcgctggaacccggtgatccagtacacttccaactattacaagtctaataatgttgaatttgctgttaatactgaaggtgtatatagtgaaccccgccccattggcaccagatacctgactcgtaatctg

SEQ ID NO: 647 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtggggcctactacaatggcttcaggcggtggcgcaccaatggcagacaataacgaaggcgtcgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgttacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagccacaaagcttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 648 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagagacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcgttcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 649 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgtcttttgggggcaacctcgggcgagcagtcttccaggccaagaagcgggttctcgaacctctcggtctggttggggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 650 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacgacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgcgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggcctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacggacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 651 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcggctcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctcccatcgaccaatacctgtattacctgaacagaactcaaaatcagtccgggagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgactttactgtggacaacaatggactttatactgagcctcgccccattggcacccgttaccttacccgtcccctg

SEQ ID NO: 652 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctgtggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 653 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcaactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcaccagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccgacgttgattttactgtggacaacaatggactttatactgagcctcgccccattggcacccgttaccttacccgtcccctg

SEQ ID NO: 654 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaagagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccgcaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcctccgtacgtcctcggctctgcgcaccagggctgcctccctccgttcccggcggacgtgttcatgattccgcaatacggccacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgacgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 655 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaagagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctacgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaccacgcctgttcctgcgaatcctccggcggagttttcagctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgattttactgtggacgacaatggactttatactgagcctcgccccattggcacccgttaccttacccgtcccctg

SEQ ID NO: 656 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgctacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacgacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 657 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagctccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagcgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcgaaatctgccaacgttgattttactgtggacaacaatggactttatactgagcctcgccccgttggcacccgttaccttacccgtcccctg

SEQ ID NO: 658 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccatacctgcggtataaccacgccgacgccgagtttcaggagcgtctgcaagaaaatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccactttccaccacgtgactggcagcgactcatcaacaacaattggggattccggcccaagagactcaacttcaaactcttcaacatccaagtcaaggaggtcacgtcgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggtccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 659 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcacgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgggcctcgccccattggcacccgttaccttacccgtcccctg

SEQ ID NO: 660 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgccccaggaaattggcattgcgactccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcacagctatggcctcacacaaagacgacgaagacaagttctttcccatgagcggtgtcatgatttttggaaaagagagcgccggagcttcaaacactgcattggacaatgtcatgattacaggcgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 661 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacagactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaggaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcgccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcggccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatatagcctcaatgggcgtgaatccatcatcaaccctggcactgctatggcctcacacaaagacgacgaagacaagttctttcccatgggcggtgtcatgatttttggaaaagagagcgccggagcttcaaacactgcattggacaatgccatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 662 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactctaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggaacattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 663 - DNA, 2208 bp, Artificial Sequence
  Description of Artificial Sequence: Synthetic polynucleotide
atggctgccgatggttatctcccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcagcgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaagagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgccaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 664 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaaggggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctg

SEQ ID NO: 665 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgtttatgattccgcagtacggctacctaacgctcaacaatggcagccaggccgtgggacgttcatccttttactgcccggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 666 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcgacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 667 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacactcgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagttacgggcacagccagagcctggaccggctgatgaatcttctcatcgaccaatacctgtattacctgaacagaactcaaaatcagtccggaagtgcccaaaacaaggacttgctgtttagccgtgggtctccagctggcatgtttgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 668 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccaacacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaatgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgcggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 669 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacgggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtccgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 670 - DNA, 2208 bp, Artificial Sequence
  Description of Artificial Sequence: Synthetic polynucleotide
  modified_base (305)..(305): a, c, t, g, unknown or other
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggngcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcggcagagtcatcaccaccagcacccgcacctgggccttgcccacctacaataaccacctctacaagcaaatctccagtgcttcaacgggggccagcaacgacaaccactacttcggccacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgtccccggcggacgtgttcatgattccgcagtacggctacctaacactcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacaaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcaacacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 671 - DNA, 2208 bp, Artificial Sequence
  Description of Artificial Sequence: Synthetic polynucleotide
atggctgccgatggttattttccagattggctcgaggacaacctttctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaggacaggccagcagcccgctaaaaagagactcaattttggtcagactggcgactcagagtcagtccccgacccacaacctctcggagaacctccagcgacccccgctgctgtgggacctactacaatggcttcaggcggtggcgcaccaatggcagacaataacgaaggtgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcccagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatagtgagcctcgccccattggcacccgttaccttacccgtcccttg

SEQ ID NO: 672 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaacctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagactacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 673 - DNA, 2208 bp, Artificial Sequence
  Description of Artificial Sequence: Synthetic polynucleotide
atggctgccgatggttatcctccagattggctcgaggacaacctctctgagggcattcgcgagtggtgggacttgaaacctggagtcccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 674 - DNA, 2196 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagccttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacccatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttacctt

SEQ ID NO: 675 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactctcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 676 - DNA, 2208 bp, Artificial Sequence
  Description of Artificial Sequence: Synthetic polynucleotide
atggctgccgatggttatcttccagattggctcgaggacaacctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgctcaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgacctatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggaacttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 677 - DNA, 2208 bp, Artificial Sequence
  Description of Artificial Sequence: Synthetic polynucleotide
atggctgccgatggttatcttccagattggctcgaggacagcctctctgagggcattcgcgagtggtgggacttgaaacctggagccccgaaacctaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaaccttttggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgacccacaacctctcggagaacctccagcaacccccgctgctgtgggacctactacgatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaagctcttcaacatccaagtcaaggaggtcacgacgaacgatggcgtcacgaccatcgctaataaccttaccagcacggttcaagtcttctcggattcagagtaccaactgccgtacgtcctcggctctgcgcaccagggctgcctccctccgttcccggcggacgtgttcatgattccgcagtacggctacctaacgcccaacaatggcagccaggccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaataccagtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaatactgcattggacaatgtcatgatcacagatgaagaggaaattaaagccactaaccctgtggccaccgaaagatttgggaccgtggcagtcaatttccagagcagcagcacagaccccgcgaccggagatgtgcatgttatgggagccttacctggcatggtgtggcaagacagagacgtatacctgcagggtcccatttgggccaaaattcctcacacggatggacactttcacccgtctcctctcatgggcggctttggacttaagcacccgcctcctcaaatcctcatcaaaaacacgcctgttcctgcgaatcctccggcagagttttcggctacaaagtttgcttcattcatcacccagtactccacaggacaagtgagtgtggaaattgaatgggagctgcagaaagaaaacagcaagcgctggaatcccgaagtgcagtacacatccaattatgcaaaatctgccaacgttgatttcactgtggacaacaatggactttatactgagcctcgccccattggcacccgttaccttacccgtcccttg

SEQ ID NO: 678 - DNA, 2208 bp, Artificial Sequence; identical to SEQ ID NO: 669
  Description of Artificial Sequence: Synthetic polynucleotide

SEQ ID NO: 679 - DNA, 2205 bp, Artificial Sequence
  Description of Artificial Sequence: Synthetic polynucleotide
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcgggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctg

SEQ ID NO: 680 - protein, 736 aa, Artificial Sequence
  Description of Artificial Sequence: Synthetic polypeptide
MAADGYLPDWLEDNLSEGIREWWALKPGAPQPKANQQHQDNARGLVLPDYKYLGPGNGLDKGEPVNAADVAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDGVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLPKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 681 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKRRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQIKEVTDNNGVKTIANNLTSTVQVFTDLDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 682 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVSDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPSPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDDVDADKVIITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 683 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHAGAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGAGGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHGGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRSYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 684 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVVTTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSHAHSQSLDRLMNPLIDQYLHYLSKTINGSGQNQQTLKFSVAGHSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIGWELQKENSKRWNPEIQYTSNYYKSNNVEFAVNTEGVYSEPRPIGTRYLTRNL

SEQ ID NO: 685 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNRLYKQISNSTSGGSSNDNAYFGYSTPWGYFDFNRFHCHFSPRDWQRLINNNWGFRPKRLNFKPFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 686 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASYKEGEDSFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQTLIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 687 - protein, 736 aa, Artificial Sequence; identical to SEQ ID NO: 686
  Description of Artificial Sequence: Synthetic polypeptide

SEQ ID NO: 688 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKSGQQPAKKRLNFGQTGDSESVPDPQPLGEPPATPAALGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSKAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 689 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 690 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFGYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWDPEIQYTSNYYKSNNVEFAVNTEGVYSEPRPIGTRYLTRNL

SEQ ID NO: 691 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCRFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNAPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 692 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVSAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 693 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNTAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 694 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGSNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPAATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQHTSNYYKSNNVEFAVNTEGVYSEPRPIGTRYLTRNL

SEQ ID NO: 695 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFRLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQSQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 696 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWRYFDFNRFHCHFSPRDWQRLINNWGFRPKRLNFKLFNIQVKEVTDNNGVKTIANNLTSTVQAFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDELNSFITQYSTGQVSVEIEWELQKENSKRWNPEIQYTSNYYKSNNVEFAVNTEGVYSEPRPIGTRYLTRNL

SEQ ID NO: 697 - protein, 735 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQDKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 698 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRAITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMTTNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 699 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQTKKRLLEPLGLVEEAAKTAPGKKRPVEQSPQEPGSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 700 - protein, 736 aa, Artificial Sequence
  Description of Artificial Sequence: Synthetic polypeptide
MAADGYFPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGESPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYLPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAVASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 701 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQAATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 702 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGPVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWRRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 703 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNLYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 704 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 705 - protein, 736 aa, Artificial Sequence
  Description of Artificial Sequence: Synthetic polypeptide
  MOD_RES (442)..(442): Any amino acid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISTSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDXYLHYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPDMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 706 - protein, 736 aa, Artificial Sequence; identical to SEQ ID NO: 686
  Description of Artificial Sequence: Synthetic polypeptide

SEQ ID NO: 707 - protein, 736 aa, Artificial Sequence; identical to SEQ ID NO: 690
  Description of Artificial Sequence: Synthetic polypeptide

SEQ ID NO: 708 - protein, 736 aa, Artificial Sequence
  Description of Artificial Sequence: Synthetic polypeptide
MAADGYLPDWLEDNLSEGIREWWALKPGAPQPRANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDCQLPYVLGSAHEGCLPPFPADVFMIPQYGYLTLNDGSQAVGRSSFYCLEYFPSQMLRTGNNFQFSYEFENVPFHSSYAHSQSLDRLTNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESHGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 709 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPPIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYGEPRPIGTRYLTRNL

SEQ ID NO: 710 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDRQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 711 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCNSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPGNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 712 - protein, 736 aa, Artificial Sequence
  Description of Artificial Sequence: Synthetic polypeptide
MAADGYLPDWLEDNLSEGIREWWALKPGAPQPKANQQHQDNARGLVLPGYRYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTVANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSGPRPIGTRYLTRNL

SEQ ID NO: 713 - protein, 736 aa, Artificial Sequence; identical to SEQ ID NO: 123
  Description of Artificial Sequence: Synthetic polypeptide

SEQ ID NO: 714 - protein, 736 aa, Artificial Sequence
  Description of Artificial Sequence: Synthetic polypeptide
MAADGYLPDWLEDNLSEGIREWWALKPGAPQPKANQQRQDNARGLVLPGYKYLGPGNGLDKGEPVNAADAAALEHDKAYDQQLKAGGNPCLKYNHADAEFQERLKEDTSFGGNLGRAVFQAKKRLLEPLGLVEEAAKTAPGKKRPVEQSPQEPDSSAGIGRSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKAIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIDGSGQNQQTLKFSVAGPSNMAVQGRNYIPGPSYRQQRVSTTVTQNNNSEFAWPGASSWALNGRNSLMDPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTGGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 715 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKPNNVEFAVNTEGVYSEPRPIGTRYLTRNL

SEQ ID NO: 716 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRPLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPTMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 717 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALVHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFTIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGPRYLTRNF

SEQ ID NO: 718 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHNKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVRSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 719 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFELFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQSSYEFENVPFHSSYAHSQSLDRLMNPLIDQYLYYLSKTINGSGQNQQTLKFSVAGPSNMAVQGRNYIPGPSYRQQRASTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 720 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPPGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISGSGQNQQTLKFSVAGPSNMAVQGRNYIPGPSYRQQRVSTTVTQNNSSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILSGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 721 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 722 - protein, 736 aa, Artificial Sequence; identical to SEQ ID NO: 721
  Description of Artificial Sequence: Synthetic polypeptide

SEQ ID NO: 723 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKCNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLDYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQGRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 724 - protein, 736 aa, Artificial Sequence; identical to SEQ ID NO: 721
  Description of Artificial Sequence: Synthetic polypeptide

SEQ ID NO: 725 - protein, 736 aa, Artificial Sequence
  Description of Artificial Sequence: Synthetic polypeptide
MAADGYPPDWLEDNLSEGIREWWALKPGAPQPKANQQHQDNARGLVLPGYKYLGPGNGLDKGEPVNAADAAALEHDKAYDQQLKAGDNPHLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDRLNSFITQYSTGQVSVEIEWELQKENSKRWNPEIQYTSNYYKSNNVEFAVNTEGVYSEPRPIGTRYLTRNL

SEQ ID NO: 726 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 727 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLTNNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYIPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 728 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLISGKQGTGRDNVDANKVMITNEEEIKTTNPVATESYGQVATNHQSAQAQAQTGWVQNQGILPGMVWQDRDVYLQGPIWAKIPHTDGNFHPSPLMGGFEMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 729 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTIASGGGAPVADNNEGADGVGSSSGNWHCDSQWLGDRVITTSTRTWALPTYNNHLYKRISNSTSGGSSNDNAYFGYSTPWGYFDFNRFHCHFSPRDWQRLINNNWGFRPKRLNFKLFNIRVKEVTDNNGVKTITNNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTRNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 730 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTEPVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPAGVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTATQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 731 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAGFQERLKEDTSFGGNLGRAVFQAKKRLLEPLGLVEEAAKTAPGKKRPVEQSPQEPDSSAGIGKSGAQPAKKRLNFGQTGDTESVPVPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGAGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 732 - protein, 736 aa, Artificial Sequence
  Description of Artificial Sequence: Synthetic polypeptide
  MOD_RES (126)..(126): Any amino acid
MAADGYLPDWLEDNLSEGIRERWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLXEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSPDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGVKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 733 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYLGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 734 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLDSFITQYSTGQVSVEIEWELQKENSKRWNPVIQYTSNYYKSNNVEFAVNTEGVYSEPRPIGTRYLTRNL

SEQ ID NO: 735 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGVDGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKLASFITQYSTGQVSVEIEWELQKENSKRWNPEVQYTSNYAKSANVDFTVDNNGLYTEPRPIGTRYLTRPL

SEQ ID NO: 736 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKRRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 737 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVGEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 738 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPRPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGPPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 739 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGGSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPPIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 740 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 741 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQQLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSTSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSADVDFTVDNNGLYTEPRPIGTRYLTRPL

SEQ ID NO: 742 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQPPYVLGSAHQGCLPPFPADVFMIPQYGHLTLNNGSQAVGRSSFYCLEYFPSQMLRTGNNFTFSYTFEEVPFHSSYAHSQSLDRLTNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 743 - protein, 736 aa, Artificial Sequence
  Description of Artificial Sequence: Synthetic polypeptide
MAADGYLPDWLEDNLSEGIREWWDLKPGAPKPKANQQEQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHATGTLPGMVWQDRDVYLQGPIWAKIPHTDGHFHPSPLMGGFGLKNPPPQILIKTTPVPANPPAEFSATKFASFITQYSTGQVSVEIEWELQKENSKRWNPEVQYTSNYAKSANVDFTVDDNGLYTEPRPIGTRYLTRPL

SEQ ID NO: 744 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSLQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNDNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 745 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEAPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPVGTRYLTRPL

SEQ ID NO: 746 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQENTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFPPRDWQRLINNNWGFRPKRLNFKLFNIQVKEVTSNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 747 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGTSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTGPRPIGTRYLTRPL

SEQ ID NO: 748 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNAPGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITGEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 749 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNRLDKGEPVNAADAAALEHDKAYDQQLKAGDNPYLRYNHADAEFQERLQEDTSFGGNLGRAVFQAKKRVLEPLGLVEEGAKTAPGRKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGGQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYSLNGRESIINPGTAMASHKDDEDKFFPMGGVMIFGKESAGASNTALDNAMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 750 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNSTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGTLPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 751 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVSAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKERLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 752 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEGEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 753 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCPEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 754 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSDTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 755 - protein, 736 aa, Artificial Sequence
  Description of Artificial Sequence: Synthetic polypeptide
MAADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYGHSQSLDRLMNLLIDQYLYYLNRTQNQSGSAQNKDLLFSRGSPAGMFVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 756 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTNTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLMLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPAATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 757 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 758 - protein, 736 aa, Artificial Sequence
  Description of Artificial Sequence: Synthetic polypeptide
  MOD_RES (102)..(102): Any amino acid
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQXRLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGGRVITTSTRTWALPTYNNHLYKQISSASTGASNDNHYFGHSTPWGYFDFNRFHCHFSPRDWQRLINNNWGFRPKRLNFKLFNIQVKEVTTNDGVTTIANNLTSTVQVFSDSEYQLPYVLGSAHQGCLPPSPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNFQSSNTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 759 - protein, 736 aa, Artificial Sequence
  Description of Artificial Sequence: Synthetic polypeptide
MAADGYFPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGRTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSPDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYSEPRPIGTRYLTRPL

SEQ ID NO: 760 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQTSSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDYNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 761 - protein, 736 aa, Artificial Sequence
  Description of Artificial Sequence: Synthetic polypeptide
MAADGYPPDWLEDNLSEGIREWWDLKPGVPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 762 - protein, 732 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQAFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDPYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYL

SEQ ID NO: 763 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHSHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 764 - protein, 736 aa, Artificial Sequence
  Description of Artificial Sequence: Synthetic polypeptide
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDLYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGTSNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 765 - protein, 736 aa, Artificial Sequence
  Description of Artificial Sequence: Synthetic polypeptide
MAADGYLPDWLEDSLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTPNNGSQAVGRSSFYCLEYFPSQMLRTGNNFTFSYTFEEVPFHSSYAHSQSLDRLMNPLIDQYQYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 766 - protein, 736 aa, Artificial Sequence; identical to SEQ ID NO: 757
  Description of Artificial Sequence: Synthetic polypeptide

SEQ ID NO: 767 - protein, 735 aa, Artificial Sequence
  Description of Artificial Sequence: Synthetic polypeptide
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSRAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 768 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgcctcccgccgtttccagcggacgtcttcatggtccctcagtatggatacctcaccctgaacaacggaagtcaagcggtgggacgctcatccttttactgcccggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcaccctattggaacccggtatctcacacgaaacttgtaa

SEQ ID NO: 769 - DNA, 2211 bp, Artificial Sequence
  Description of Artificial Sequence: Synthetic polynucleotide
atggctgctgatggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactgttgccaataaccttaccagcacggttcaagtgtttacggactcggagtatcaactcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 770 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccggccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacggcaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtgtggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 771 - DNA, 2212 bp, Artificial Sequence
  Description of Artificial Sequence: Synthetic polynucleotide
  modified_base (1283)..(1283): a, c, t, g, unknown or other
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggaccgggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggtccaagtgtttacggactcggagtatcagctcccgtacgtgctcgggtcggcgcaccaaggctgtctcccgccgtttccagcggacgccttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacggcagctacgctcacagccngagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagacttttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaactcgtaa

SEQ ID NO: 772 - DNA, 2212 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcttgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccggccaatcaggagcttcaaacgacaaccactactttggctacagcaccccctgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatcccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 773 - DNA, 2212 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtgcctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtagcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatggatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacctgtaa

SEQ ID NO: 774 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcaacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 775 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacgaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcggacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagtgcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 776 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaaggggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgttcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagttcggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttgaacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 777 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacgaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccacctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 778 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgagggagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacagccatctctacaagcaaatctccagccaatcaggagcttcaaacgacaaccactactttggctacagcaccccttggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgccttcatggtccctcagtatggatacctcaccctgaacaacggaagtcaagcggtgggacgctcatccttttactgcctggagtacttcccttcgcagatgctaaggactggaaataacttccaattcagctataccctcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaaggacgatgaagaaaaatttttccctatgcacggcaatctaatatttggcaaagaagggacaacggcaagtaacgcagaattagatagtgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 779 - DNA, 2205 bp, Artificial Sequence
  Description of Artificial Sequence: Synthetic polynucleotide
atgactgacggttaccttccagattggctagaggacaacctctctgagggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcaactggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacctttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgctaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 780 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttcttaccacgtgactggcagcgactcatcaacaacaactggggcgtgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcgacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 781 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacgagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgctaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 782 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacggaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattccccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggcggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 783 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctaccgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 784 - DNA, 2205 bp, Artificial Sequence
  Description of Artificial Sequence: Synthetic polynucleotide
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttcagggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaaccccttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacccggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaataactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgcccggacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcgacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 785 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaggctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacggaggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 786 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatcctccgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctagtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 787 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacactgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagagcacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 788 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccctgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggtccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgccgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtgcaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctattggaacccgataccttacccgacccctttaa

SEQ ID NO: 789 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacaccgaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcgcgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 790 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacggggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagcgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 791 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttactaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagggggacgtgtacctccaaggacccatctgggccaagatcccagagacgggggcgcactttcacccctctccggccatgggcggattcggactcaagcacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 792 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggtccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccgagaggtggaacccagagatccagtacacaaacaactacaacgacccccagtttgtggactttgccccggacagcaccggggaatacagaaccaccagacctattggaacccgataccttacccgacccctttaa

SEQ ID NO: 793 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacagcgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccgccagacctatcggaacccgataccttacccgacccctttaa

SEQ ID NO: 794 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccctgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatgaccaccaacaaccagagctccaccactgcccccgcgaccggcacgtacaacctccaggaaatcgtgcccggcagcgtgtggatggagagggacgtgtacccccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacaggaccaccagacctatcggaacccgataccttacccgacccctttaa

SEQ ID NO: 795 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcctctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatgaagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 796 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaggcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccaccccgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 797 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacccacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagtcgaacggcatgaccaacaacctccggggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 798 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacagcgtcggcgggcagatggccaccaacaaccagagctccaccactgcccccacgaccggcacgtacaacctccaggaaatcgtgcccggcagcgtgtggatggagagggacgtgtacctccaaggacccatctgggccaagatcccagagacgggggcgcactttcacccctctccggccatgggcggattcagactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 799 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccgcgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcggcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaataccaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 800 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggtagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcggcaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggggcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccctcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 801 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgagccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatgcagaaccaccagacctatcggaacccgataccttacccgacccctttaa

SEQ ID NO: 802 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcctcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtgggccagtacttgtaccgcttcgtgagcacaaataacactggcggagtccagttcaacgagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggccaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 803 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggcctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccatcatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgcccccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 804 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcctctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 805 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgccaacagggcagacgaggtcgcgcgagagcacgacatctcgtacaacgagcagcttgaggcgggagacaacccctacctcaagtacaaccacgcgggcgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccggctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataatactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 806 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccgccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 807 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagccgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 808 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 809 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagcctcccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgccgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcgccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 810 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 811 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggctgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagccaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaaccttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggtgcacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccggagatccagtacacaaacaactacaacgacccccagtttgtggactttgccccggacagcaccggggaatacagaaccaccagacctatcggaacccgataccttacccgacccctttaa

SEQ ID NO: 812 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaggcaacgccaacgcctactttggatacagcaccccctgggggtactttgactttaaccgcttccacagccactggagcccccgggactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgcgcccggaaatatcaccagcttctcggacgtgcccgtcagcagcttcatcacccagtacagcaccgggcaggtcaccgtggagatggagtgggagctcaagaagggaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 813 - DNA, 2175 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacgtccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggtgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 814 - DNA, 2175 bp, Artificial Sequence
  Description of Artificial Sequence: Synthetic polynucleotide
  modified_base (1652)..(1652): a, c, t, g, unknown or other
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggcccggaccgaggaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcagcatgctcatcaccancgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 815 - DNA, 2211 bp, Artificial Sequence
  Description of Artificial Sequence: Synthetic polynucleotide
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagaggcctgtagatcagtctcctcaggaaccggactcatcatctggtgttggcaaatcgggcaaacagcctgccagaaaaagactaaatttcggtcagactggcgactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactagaactgtcaatgatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 816 - DNA, 2205 bp, Artificial Sequence; identical to SEQ ID NO: 84
  Description of Artificial Sequence: Synthetic polynucleotide

SEQ ID NO: 817 - DNA, 2234 bp, Artificial Sequence
  Description of Artificial Sequence: Synthetic polynucleotide
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctc

SEQ ID NO: 818 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCPEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPHPIGTRYLTRNL

SEQ ID NO: 819 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTVANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 820 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISGQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANGNNNSNFPWTAASKYHLNGRDSLVNPGPAMASHKDDEEKFFPMHGNLIFGKEGTTASNAELDNVMITDEEEIRTTNPVATEQCGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 821 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADAFMVPQYGYLTLNNGSQAVGRSSFYCLEYFPSQMLRTGNNFQFSYTFEDVPFHGSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNS

SEQ ID NO: 822 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQLARKRLNFGQTGDSESVPDPQPLGEPPAAPTSLGSNTMASGGGAPMADNNEGADGVGNSSGNWHCDSQWLGDRVITTSTRTWALPTYNSHLYKQISGQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 823 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPCLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGSAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMDPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 824 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGNRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 825 - protein, 736 aa, Artificial Sequence
  Description of Artificial Sequence: Synthetic polypeptide
MAADGYLPDWLEDNLSEGIREWWALKPGVPQPKANQQHQDDRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATVQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 826 - protein, 735 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKGILEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVFGSAHQGCLPPFPADVFMVPQYGYLTLNNGSQAVGRSSFYCLEYFPSQMLRTGNNFQFSYTFEDVPFHSSYAHSQSSDRLMNPLIDQYLYYLNRTQGTTSGTTNQSRLLFSQAGPQSMSLQARNWLPGPCYRQQRLSKTANDNNNSNFPTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 827 - protein, 736 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDEGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 828 - protein, 668 aa, Artificial Sequence
  Description of Artificial Sequence: Synthetic polypeptide
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEGAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNSHLYKQISSQSGASNDNHYFGYSTPWGILTLTDSTATSHHVTGSDSLTTTGDSGPRNSASSSSTSKLKRSRRTMARRLLPITLPARFKCLRTRSISSRTCSGRRTKAVSRRFQRTPSWSLSMDTSPTTEVKRWDAHPFTAWSTSLRRCGLEITSNSAIPSRMYLFTAATLTARVWIAILLLISICTTTERKEQPLEQPTNHGCFLARLGLSLCLCRPEIGYLGPATGNRDFQRLLTTTTTVTFLGQRPANIISMAATRWIQDQLWPVTRTMKKNFSLCTAIRGPYLAWCGKIVTCTFKDLSGQRFLTRMDTFILLLWEALDNIRLLKSSKILRYRQILRRLSARPSLLHLSLSTPLDRSAWKLSGSYRKKTANVGIQRFSTLPTTTSLLMWTLLTLMVFIVNLALLEPGISHETC

SEQ ID NO: 829 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAATGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNLSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 830 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFLPRDWQRLINNNWGVRPKAMRVKIFNIQVKEVTTSNGETTVANNLTSTVQIFADSSYELPYVMDAGQEGSLPPFPNDVFMVPQYGYCGLVTGDTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 831 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDEGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 832 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDGTGAGDGPPEGSTSGAMSDDSEMRAAAGGAAVEGGQGADGVGNASGDWHCDSTWSEGHVTTTSTRTWVLPTYNNHLYKRLGESLQSNTYNGFPTPWGYFDFNRFHCHFSPRDWQRLINNNWGMRPKAMRVKIFNIQVKEVTTSNGETTAANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 833 - protein, 734 aa, Artificial Sequence
  Description of Artificial Sequence: Synthetic polypeptide
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYRGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 834 - protein, 734 aa, Artificial Sequence
  Description of Artificial Sequence: Synthetic polypeptide
MTDGYLPDWLEDNLSEGVREWWALQPGAPKPKANQQHQDNARGLVLQGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTRSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSARTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 835 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQERLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETEAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 836 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSSGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 837 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKSTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 838 - protein, 724 aa, Artificial Sequence
  Description of Artificial Sequence: Synthetic polypeptide
MSFVDHPPDWLEEVGEGLREFLGPEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKVRTEEDSKPSTSSDAEAGPSGSQQLQIPAQPASSLGADTMSAGGGGPLGDNNQGADGVGNASGDWHCDSTWMGDRVVTKSTRTWVPPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVACNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 839 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGAYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 840 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADGVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQAFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 841 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYVPPQPNGMTNNLQGSNTYALENTMIFNSQPANPGTTATYLEGNMLITSESETQPVNRVAYNVGGQMATNNQSSTTAPATGTYNLQEIVPGSVWMEGDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 842 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKVRTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSERWNPEIQYTNNYNDPQFVDFAPDSTGEYRTTRPIGTRYLTRPL

SEQ ID NO: 843 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYSEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTARPIGTRYLTRPL

SEQ ID NO: 844 - protein, 724 aa, Artificial Sequence
  Description of Artificial Sequence: Synthetic polypeptide
MSFVDHPPDWLEEVGEGLREFLGPEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMTTNNQSSTTAPATGTYNLQEIVPGSVWMERDVYPQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 845 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFLCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMKRDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 846 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTPSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 847 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTHKNWFPGPMGRTQGWNLGSGVNRASVSAFATTNRMELEGASYQVPPQSNGMTNNLRGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 848 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYSVGGQMATNNQSSTTAPTTGTYNLQEIVPGSVWMERDVYLQGPIWAKIPETGAHFHPSPAMGGFRLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 849 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFAATNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGGVWMERDVYLQGPIWAKIPETGAHFHPSPAMGGFGLKHPPPMMLIKNTPVPGNTTSFSDVPVSSFITQYSTGQVTVEMEWELKKENSKRWNPEIQYTNNYNDPQFVDFAPDSTGEYRTTRPIGTRYLTRPL

SEQ ID NO: 850 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKVVFQAKKRVLEPFGLVEEGAKTAPTGKRIDDHFPKRKKARTEEDSKPSTSSDAEAGPSGSQQLQIPAQPASSLGADTMSAGGGGPLGGNNQGADGVGNASGDWHCDSTWMGDRVVTKSTRTWVLPSYNNHQYREIKSGSVDGSNANAYFGYSTPWGYFDFNRFHSHWGPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSALATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 851 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGECRTTRPIGTRYLTRPL

SEQ ID NO: 852 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKILNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVGQYLYRFVSTNNTGGVQFNENLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQATVEMEWELKKENSKRWNPEIQYTNNYNDPQFVDFAPDSTGEYRTTRPIGTRYLTRPL

SEQ ID NO: 853 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTIIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 854 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSLSDVPVSSFITQYSTGQVTVEMEWELKKENSKRWNPEIQYTNNYNDPQFVDFAPDSTGEYRTTRPIGTRYLTRPL

SEQ ID NO: 855 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPANRADEVAREHDISYNEQLEAGDNPYLKYNHAGAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPGYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 856 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSATTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 857 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQPQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKENSKRWNPEIQYTNNYNDPQFVDFAPDSTGEYRTTRPIGTRYLTRPL

SEQ ID NO: 858 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 859 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPPTSSDAEAGPSGSQQLQIPAQPASSLGADTMSAGGGGPLGDNNQGADGVGNASGDWHCDSTWMGDRVVTKSTRTWVPPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVAVEMEWELKKENSKRWNPEIQYTNNYNDPQFVDFAPDSTGEYRTTRPIGTRYLTRPL

SEQ ID NO: 860 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKENSKRWNPEIQYTNNYNDPQFVDFAPDSTGEYRTTRPIGTRYLTRPL

SEQ ID NO: 861 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLAEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRAKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNLEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVVHNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 862 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGGNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPAPGNITSFSDVPVSSFITQYSTGQVTVEMEWELKKGNSKRWNPEIQYTNNYNDPQFVDFAPDSTGEYRTTRPIGTRYLTRPL

SEQ ID NO: 863 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGVHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 864 - protein, 724 aa, Artificial Sequence
  Description of Artificial Sequence: Synthetic polypeptide
  MOD_RES (551)..(551): Any amino acid
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGSMLITXESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 865 - protein, 736 aa, Artificial Sequence; identical to SEQ ID NO: 39
  Description of Artificial Sequence: Synthetic polypeptide

SEQ ID NO: 866 - protein, 734 aa, Artificial Sequence; identical to SEQ ID NO: 57
  Description of Artificial Sequence: Synthetic polypeptide

SEQ ID NO: 867 - protein, 723 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 868 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 869 - DNA, 2232 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgcccaaactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 870 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIQSSQTPRQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 871 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIILGTGTSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTRTNPEAAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 872 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIILGTGTSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQNGGTSSSAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 873 - protein, 7 aa, Artificial Sequence
  Description of Artificial Sequence: Synthetic peptide
TLAVPFK

SEQ ID NO: 874 - protein, 7 aa, Artificial Sequence
  Description of Artificial Sequence: Synthetic peptide
KFPVALT

SEQ ID NO: 875 - protein, 6 aa, Artificial Sequence
  Description of Artificial Sequence: Synthetic peptide
LAVPFK

SEQ ID NO: 876 - protein, 5 aa, Artificial Sequence
  Description of Artificial Sequence: Synthetic peptide
AVPFK

SEQ ID NO: 877 - protein, 4 aa, Artificial Sequence
  Description of Artificial Sequence: Synthetic peptide
VPFK

SEQ ID NO: 878 - protein, 6 aa, Artificial Sequence
  Description of Artificial Sequence: Synthetic peptide
TLAVPF

SEQ ID NO: 879 - protein, 5 aa, Artificial Sequence
  Description of Artificial Sequence: Synthetic peptide
TLAVP

SEQ ID NO: 880 - protein, 4 aa, Artificial Sequence
  Description of Artificial Sequence: Synthetic peptide
TLAV

SEQ ID NO: 881 - protein, 7 aa, Artificial Sequence
  Description of Artificial Sequence: Synthetic peptide
SVSKPFL

SEQ ID NO: 882 - protein, 7 aa, Artificial Sequence
  Description of Artificial Sequence: Synthetic peptide
FTLTTPK

SEQ ID NO: 883 - protein, 7 aa, Artificial Sequence
  Description of Artificial Sequence: Synthetic peptide
MNATKNV

SEQ ID NO: 884 - protein, 7 aa, Artificial Sequence
  Description of Artificial Sequence: Synthetic peptide
QSSQTPR

SEQ ID NO: 885 - protein, 7 aa, Artificial Sequence
  Description of Artificial Sequence: Synthetic peptide
ILGTGTS

SEQ ID NO: 886 - protein, 7 aa, Artificial Sequence
  Description of Artificial Sequence: Synthetic peptide
TRTNPEA

SEQ ID NO: 887 - protein, 7 aa, Artificial Sequence
  Description of Artificial Sequence: Synthetic peptide
NGGTSSS

SEQ ID NO: 888 - protein, 7 aa, Artificial Sequence
  Description of Artificial Sequence: Synthetic peptide
YTLSQGW

SEQ ID NO: 889 - DNA, 21 bp, Artificial Sequence
  Description of Artificial Sequence: Synthetic oligonucleotide
aagtttcctgtggcgttgact

SEQ ID NO: 890 - DNA, 21 bp, Artificial Sequence
  Description of Artificial Sequence: Synthetic oligonucleotide
actttggcggtgccttttaag

SEQ ID NO: 891 - DNA, 21 bp, Artificial Sequence
  Description of Artificial Sequence: Synthetic oligonucleotide
agtgtgagtaagccttttttg

SEQ ID NO: 892 - DNA, 21 bp, Artificial Sequence
  Description of Artificial Sequence: Synthetic oligonucleotide
tttacgttgacgacgcctaag

SEQ ID NO: 893 - DNA, 21 bp, Artificial Sequence
  Description of Artificial Sequence: Synthetic oligonucleotide
atgaatgctacgaagaatgtg

SEQ ID NO: 894 - DNA, 21 bp, Artificial Sequence
  Description of Artificial Sequence: Synthetic oligonucleotide
cagtcgtcgcagacgcctagg

SEQ ID NO: 895 - DNA, 21 bp, Artificial Sequence
  Description of Artificial Sequence: Synthetic oligonucleotide
attctggggactggtacttcg

SEQ ID NO: 896 - DNA, 21 bp, Artificial Sequence
  Description of Artificial Sequence: Synthetic oligonucleotide
acgcggactaatcctgaggct

SEQ ID NO: 897 - DNA, 21 bp, Artificial Sequence
  Description of Artificial Sequence: Synthetic oligonucleotide
aatggggggactagtagttct

SEQ ID NO: 898 - DNA, 21 bp, Artificial Sequence
  Description of Artificial Sequence: Synthetic oligonucleotide
tatactttgtcgcagggttgg

SEQ ID NO: 899 - DNA, 609 bp, Unknown
  Description of Unknown: Internal ribosome entry site
aattccgcccctctcccccccccccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataatatggccacaacc

SEQ ID NO: 900 - DNA, 75 bp, Foot and mouth disease virus
  2A sequence
ggaagcggagtgaaacagactttgaattttgaccttctcaagttggcgggagacgtggagtccaaccctggacct

SEQ ID NO: 901 - DNA, 66 bp, Porcine teschovirus 1
  2A sequence
ggaagcggagctactaacttcagcctgctgaagcaggctggagacgtggaggagaaccctggacct

SEQ ID NO: 902 - DNA, 12 bp, Unknown
  Description of Unknown: Furin cleavage site
cgggccaagcgg

SEQ ID NO: 903 - DNA, 75 bp, Artificial Sequence
  Description of Artificial Sequence: Synthetic oligonucleotide
ggcggaggtggctccggaggcggaggcagcggcggaggtgggtctggcggaggcgggtgcggcggaggtggctcc

SEQ ID NO: 904 - protein, 8 aa, Unknown
  Description of Unknown: Linker Sequence
LWSLDTTP

SEQ ID NO: 905 - protein, 4 aa, Unknown
  Description of Unknown: Linker Sequence
MDGA

SEQ ID NO: 906 - protein, 4 aa, Unknown
  Description of Unknown: Linker Sequence
QGNY

SEQ ID NO: 907 - protein, 4 aa, Unknown
  Description of Unknown: Linker Sequence
RDGK

SEQ ID NO: 908 - protein, 5 aa, Unknown
  Description of Unknown: Linker Sequence
DLNVG

SEQ ID NO: 909 - protein, 5 aa, Unknown
  Description of Unknown: Linker Sequence
MATDE

SEQ ID NO: 910 - protein, 6 aa, Unknown
  Description of Unknown: Linker Sequence
LTGSGA

SEQ ID NO: 911 - protein, 7 aa, Unknown
  Description of Unknown: Linker Sequence
FAASGEL

SEQ ID NO: 912 - protein, 7 aa, Unknown
  Description of Unknown: Linker Sequence
FNNREEQ

SEQ ID NO: 913 - protein, 7 aa, Unknown
  Description of Unknown: Linker Sequence
GYMARNE

SEQ ID NO: 914 - protein, 7 aa, Unknown
  Description of Unknown: Linker Sequence
VGTEHAK

SEQ ID NO: 915 - protein, 5 aa, Unknown
  Description of Unknown: Linker Sequence
LNLDY

SEQ ID NO: 916 - protein, 14 aa, Unknown
  Description of Unknown: Linker Sequence
KDGVIKGYYAYINP

SEQ ID NO: 917 - protein, 4 aa, Unknown
  Description of Unknown: Linker Sequence
SKAQ

SEQ ID NO: 918 - protein, 6 aa, Unknown
  Description of Unknown: Linker Sequence
LFNASA

SEQ ID NO: 919 - protein, 6 aa, Unknown
  Description of Unknown: Linker Sequence
YQDGSV

SEQ ID NO: 920 - protein, 7 aa, Unknown
  Description of Unknown: Linker Sequence
IHPQSVI

SEQ ID NO: 921 - protein, 5 aa, Unknown
  Description of Unknown: Linker Sequence
KNPMD

SEQ ID NO: 922 - protein, 7 aa, Unknown
  Description of Unknown: Linker Sequence
LGSEVPL

SEQ ID NO: 923 - protein, 14 aa, Unknown
  Description of Unknown: Linker Sequence
LNVNNKVPNGATSM

SEQ ID NO: 924 - protein, 5 aa, Unknown
  Description of Unknown: Linker Sequence
TTDDL

SEQ ID NO: 925 - protein, 6 aa, Unknown
  Description of Unknown: Linker Sequence
AAGIRA

SEQ ID NO: 926 - protein, 6 aa, Unknown
  Description of Unknown: Linker Sequence
QAGVDC

SEQ ID NO: 927 - protein, 6 aa, Unknown
  Description of Unknown: Linker Sequence
YNPTDI

SEQ ID NO: 928 - protein, 8 aa, Unknown
  Description of Unknown: Linker Sequence
EFLPRDTG

SEQ ID NO: 929 - protein, 9 aa, Unknown
  Description of Unknown: Linker Sequence
GSGLPEQTD

SEQ ID NO: 930 - protein, 5 aa, Unknown
  Description of Unknown: Linker Sequence
YSSNV

SEQ ID NO: 931 - protein, 6 aa, Unknown
  Description of Unknown: Linker Sequence
KAGLNP

SEQ ID NO: 932 - protein, 6 aa, Unknown
  Description of Unknown: Linker Sequence
KEEGKF

SEQ ID NO: 933 - protein, 6 aa, Unknown
  Description of Unknown: Linker Sequence
VRGGIW

SEQ ID NO: 934 - protein, 9 aa, Unknown
  Description of Unknown: Linker Sequence
QRYLKPENK

SEQ ID NO: 935 - protein, 6 aa, Unknown
  Description of Unknown: Linker Sequence
EGVGEI

SEQ ID NO: 936 - protein, 8 aa, Unknown
  Description of Unknown: Linker Sequence
PVDPPEKW

SEQ ID NO: 937 - protein, 9 aa, Unknown
  Description of Unknown: Linker Sequence
AHPGVSIPT

SEQ ID NO: 938 - protein, 15 aa, Unknown
  Description of Unknown: Linker Sequence
FKDPELPRNTPKRSI

SEQ ID NO: 939 - protein, 14 aa, Unknown
  Description of Unknown: Linker Sequence
YLEGVERNPVGAGL

SEQ ID NO: 940 - protein, 5 aa, Unknown
  Description of Unknown: Linker Sequence
CPRCP

SEQ ID NO: 941 - protein, 7 aa, Unknown
  Description of Unknown: Linker Sequence
APPVAGP

SEQ ID NO: 942 - protein, 8 aa, Unknown
  Description of Unknown: Linker Sequence
APELLGGP

SEQ ID NO: 943 - protein, 9 aa, Unknown
  Description of Unknown: Linker Sequence
CCVECPPCP

SEQ ID NO: 944 - protein, 12 aa, Unknown
  Description of Unknown: Linker Sequence
ELKTPLGDTTHT

SEQ ID NO: 945 - protein, 6 aa, Unknown
  Description of Unknown: Linker Sequence
HNVDDV

SEQ ID NO: 946 - protein, 6 aa, Unknown
  Description of Unknown: Linker Sequence
AGQKDE

SEQ ID NO: 947 - protein, 9 aa, Unknown
  Description of Unknown: Linker Sequence
KLNLPILPT

SEQ ID NO: 948 - protein, 9 aa, Unknown
  Description of Unknown: Linker Sequence
SSPRVTNEG

SEQ ID NO: 949 - protein, 17 aa, Unknown
  Description of Unknown: Linker Sequence
KAAAALKGSDHRRATNV

SEQ ID NO: 950 - protein, 4 aa, Unknown
  Description of Unknown: Linker Sequence
KKRV

SEQ ID NO: 951 - protein, 5 aa, Unknown
  Description of Unknown: Linker Sequence
QLEVK

SEQ ID NO: 952 - protein, 5 aa, Unknown
  Description of Unknown: Linker Sequence
TNGRL

SEQ ID NO: 953 - protein, 10 aa, Unknown
  Description of Unknown: Linker Sequence
LYTPEIAENQ

SEQ ID NO: 954 - protein, 4 aa, Unknown
  Description of Unknown: Linker Sequence
NSEY

SEQ ID NO: 955 - protein, 5 aa, Unknown
  Description of Unknown: Linker Sequence
SMKDF

SEQ ID NO: 956 - protein, 12 aa, Unknown
  Description of Unknown: Linker Sequence
KDRWQERHILRP

SEQ ID NO: 957 - protein, 14 aa, Unknown
  Description of Unknown: Linker Sequence
DDPEGPVMPGSHSV

SEQ ID NO: 958 - protein, 23 aa, Unknown
  Description of Unknown: Linker Sequence
LCPSNPTCIYKYGDESSNSLPGH

SEQ ID NO: 959 - protein, 35 aa, Unknown
  Description of Unknown: Linker Sequence
LCEALQHNLPPFTPPPHTEDSVYPMPRVIFRMFDY

SEQ ID NO: 960 - protein, 5 aa, Unknown
  Description of Unknown: Linker Sequence
NMVTC

SEQ ID NO: 961 - protein, 10 aa, Unknown
  Description of Unknown: Linker Sequence
NLEEHLGKLN

SEQ ID NO: 962 - protein, 4 aa, Unknown
  Description of Unknown: Linker Sequence
QGAH

SEQ ID NO: 963 - protein, 6 aa, Unknown
  Description of Unknown: Linker Sequence
QRIPLY

SEQ ID NO: 964 - protein, 8 aa, Unknown
  Description of Unknown: Linker Sequence
QRKPLFYI

SEQ ID NO: 965 - protein, 4 aa, Unknown
  Description of Unknown: Linker Sequence
AGGR

SEQ ID NO: 966 - protein, 6 aa, Unknown
  Description of Unknown: Linker Sequence
YPYKGE

SEQ ID NO: 967 - protein, 7 aa, Unknown
  Description of Unknown: Linker Sequence
NHETGEL

SEQ ID NO: 968 - protein, 8 aa, Unknown
  Description of Unknown: Linker Sequence
TFELKTDV

SEQ ID NO: 969 - protein, 25 aa, Unknown
  Description of Unknown: Linker Sequence
ALGLPHSDVFRQAKDVAESDRGFSL

SEQ ID NO: 970 - protein, 4 aa, Unknown
  Description of Unknown: Linker Sequence
LKDW

SEQ ID NO: 971 - protein, 4 aa, Unknown
  Description of Unknown: Linker Sequence
WTGM

SEQ ID NO: 972 - protein, 4 aa, Unknown
  Description of Unknown: Linker Sequence
YNGL

SEQ ID NO: 973 - protein, 5 aa, Unknown
  Description of Unknown: Linker Sequence
DRPGE

SEQ ID NO: 974 - protein, 5 aa, Unknown
  Description of Unknown: Linker Sequence
LGVSI

SEQ ID NO: 975 - protein, 5 aa, Unknown
  Description of Unknown: Linker Sequence
RSTGR

SEQ ID NO: 976 - protein, 5 aa, Unknown
  Description of Unknown: Linker Sequence
YRMLP

SEQ ID NO: 977 - protein, 5 aa, Unknown
  Description of Unknown: Linker Sequence
YVNDF

SEQ ID NO: 978 - protein, 6 aa, Unknown
  Description of Unknown: Linker Sequence
EYGSPR

SEQ ID NO: 979 - protein, 6 aa, Unknown
  Description of Unknown: Linker Sequence
IDRGRV

SEQ ID NO: 980 - protein, 7 aa, Unknown
  Description of Unknown: Linker Sequence
RAADGQM

SEQ ID NO: 981 - protein, 7 aa, Unknown
  Description of Unknown: Linker Sequence
TKEKNNV

SEQ ID NO: 982 - protein, 8 aa, Unknown
  Description of Unknown: Linker Sequence
DQAGLGHE

SEQ ID NO: 983 - protein, 8 aa, Unknown
  Description of Unknown: Linker Sequence
FSQIKDAM

SEQ ID NO: 984 - protein, 8 aa, Unknown
  Description of Unknown: Linker Sequence
QAAPGKST

SEQ ID NO: 985 - protein, 8 aa, Unknown
  Description of Unknown: Linker Sequence
QLPAGATQ

SEQ ID NO: 986 - protein, 9 aa, Unknown
  Description of Unknown: Linker Sequence
AAKHPDMLT

SEQ ID NO: 987 - protein, 9 aa, Unknown
  Description of Unknown: Linker Sequence
LASKLPTGV

SEQ ID NO: 988 - protein, 9 aa, Unknown
  Description of Unknown: Linker Sequence
PNGLEDTPQ

SEQ ID NO: 989 - protein, 9 aa, Unknown
  Description of Unknown: Linker Sequence
QERLSGNQA

SEQ ID NO: 990 - protein, 12 aa, Unknown
  Description of Unknown: Linker Sequence
NGFGFAGRGQNT

SEQ ID NO: 991 - protein, 14 aa, Unknown
  Description of Unknown: Linker Sequence
RLPSSFLPDEDQGV

SEQ ID NO: 992 - protein, 15 aa, Unknown
  Description of Unknown: Linker Sequence
FNLPAIVELGTATGF

SEQ ID NO: 993 - protein, 17 aa, Unknown
  Description of Unknown: Linker Sequence
MLKPIAKGDHGEGKKGF

SEQ ID NO: 994 - protein, 7 aa, Unknown
  Description of Unknown: Linker Sequence
LAHLLPP

SEQ ID NO: 995 - protein, 9 aa, Unknown
  Description of Unknown: Linker Sequence
QAPEAGFEH

SEQ ID NO: 996 - protein, 10 aa, Unknown
  Description of Unknown: Linker Sequence
KDKFICDRPL

SEQ ID NO: 997 - protein, 16 aa, Unknown
  Description of Unknown: Linker Sequence
PVEFHNPLKGHVAEPH

SEQ ID NO: 998 - protein, 16 aa, Unknown
  Description of Unknown: Linker Sequence
QKTMPSAPAPDGLPSE

SEQ ID NO: 999 - protein, 4 aa, Unknown
  Description of Unknown: Linker Sequence
AGRV

SEQ ID NO: 1000 - protein, 6 aa, Unknown
  Description of Unknown: Linker Sequence
AGHGFA

SEQ ID NO: 1001 - protein, 10 aa, Unknown
  Description of Unknown: Linker Sequence
LPPGPGPFPG

SEQ ID NO: 1002 - protein, 11 aa, Unknown
  Description of Unknown: Linker Sequence
IFGIGGGLLEY

SEQ ID NO: 1003 - protein, 15 aa, Unknown
  Description of Unknown: Linker Sequence
AYYNFEDLPNNMDNI

SEQ ID NO: 1004 - protein, 10 aa, Unknown
  Description of Unknown: Linker Sequence
MICTRSKPKC

SEQ ID NO: 1005 - protein, 6 aa, Unknown
  Description of Unknown: Linker Sequence
QSSLDL

SEQ ID NO: 1006 - protein, 6 aa, Unknown
  Description of Unknown: Linker Sequence
IPDGDE

SEQ ID NO: 1007 - protein, 15 aa, Unknown
  Description of Unknown: Linker Sequence
PTNPVTGEIPTLSAL

SEQ ID NO: 1008 - protein, 9 aa, Unknown
  Description of Unknown: Linker Sequence
GGPCRADIK

SEQ ID NO: 1009 - protein, 11 aa, Unknown
  Description of Unknown: Linker Sequence
SGACSTDKPCG

SEQ ID NO: 1010 - protein, 11 aa, Unknown
  Description of Unknown: Linker Sequence
EGSKTVPIADK

SEQ ID NO: 1011 - protein, 7 aa, Unknown
  Description of Unknown: Linker Sequence
INGKKPE

SEQ ID NO: 1012 - protein, 8 aa, Unknown
  Description of Unknown: Linker Sequence
ELPAYMSG

SEQ ID NO: 1013 - protein, 8 aa, Unknown
  Description of Unknown: Linker Sequence
VTGTLDYG

SEQ ID NO: 1014 - protein, 15 aa, Unknown
  Description of Unknown: Linker Sequence
AAEDAIEIHPGTPNV

SEQ ID NO: 1015 - protein, 21 aa, Unknown
  Description of Unknown: Linker Sequence
LEFKMPADGRIWGSKYPRPTA

SEQ ID NO: 1016 - protein, 5 aa, Unknown
  Description of Unknown: Linker Sequence
SDYDV

SEQ ID NO: 1017 - protein, 5 aa, Unknown
  Description of Unknown: Linker Sequence
VGSGP

SEQ ID NO: 1018 - protein, 6 aa, Unknown
  Description of Unknown: Linker Sequence
IDSQSA

SEQ ID NO: 1019 - protein, 6 aa, Unknown
  Description of Unknown: Linker Sequence
NKRDAY

SEQ ID NO: 1020 - protein, 6 aa, Unknown
  Description of Unknown: Linker Sequence
RKGIRT

SEQ ID NO: 1021 - protein, 7 aa, Unknown
  Description of Unknown: Linker Sequence
MGERFGG

SEQ ID NO: 1022 - protein, 8 aa, Unknown
  Description of Unknown: Linker Sequence
VDTGAEKR

SEQ ID NO: 1023 - protein, 10 aa, Unknown
  Description of Unknown: Linker Sequence
TGGHPSKEAQ

SEQ ID NO: 1024 - protein, 10 aa, Unknown
  Description of Unknown: Linker Sequence
VPAATEGGLH

SEQ ID NO: 1025 - protein, 18 aa, Unknown
  Description of Unknown: Linker Sequence
VLDTVDIENYISVPKTEG

SEQ ID NO: 1026 - protein, 5 aa, Unknown
  Description of Unknown: Linker Sequence
DLAYV

SEQ ID NO: 1027 - protein, 13 aa, Unknown
  Description of Unknown: Linker Sequence
VVPPELKTKDHII

SEQ ID NO: 1028 - protein, 5 aa, Unknown
  Description of Unknown: Linker Sequence
WKQHK

SEQ ID NO: 1029 - protein, 7 aa, Unknown
  Description of Unknown: Linker Sequence
KIQGCSA

SEQ ID NO: 1030 - protein, 8 aa, Unknown
  Description of Unknown: Linker Sequence
DVASGDGL

SEQ ID NO: 1031 - protein, 20 aa, Unknown
  Description of Unknown: Linker Sequence
VSPWHRMSYFFNPVSNFISF

SEQ ID NO: 1032 - protein, 5 aa, Unknown
  Description of Unknown: Linker Sequence
YDNDE

SEQ ID NO: 1033 - protein, 10 aa, Unknown
  Description of Unknown: Linker Sequence
RNGDSRRPGL

SEQ ID NO: 1034 - protein, 4 aa, Unknown
  Description of Unknown: Linker Sequence
VEET

SEQ ID NO: 1035 - protein, 6 aa, Unknown
  Description of Unknown: Linker Sequence
AIQDIS

SEQ ID NO: 1036 - protein, 6 aa, Unknown
  Description of Unknown: Linker Sequence
KLPITL

SEQ ID NO: 1037 - protein, 11 aa, Unknown
  Description of Unknown: Linker Sequence
ADSAYITYAND

SEQ ID NO: 1038 - protein, 4 aa, Unknown
  Description of Unknown: Linker Sequence
FGGV

SEQ ID NO: 1039 - protein, 4 aa, Unknown
  Description of Unknown: Linker Sequence
YGIK

SEQ ID NO: 1040 - protein, 5 aa, Unknown
  Description of Unknown: Linker Sequence
INFNS

SEQ ID NO: 1041 - protein, 5 aa, Unknown
  Description of Unknown: Linker Sequence
YGRDH

SEQ ID NO: 1042 - protein, 6 aa, Unknown
  Description of Unknown: Linker Sequence
GMSRTN

SEQ ID NO: 1043 - protein, 7 aa, Unknown
  Description of Unknown: Linker Sequence
ASLGING

SEQ ID NO: 1044 - protein, 7 aa, Unknown
  Description of Unknown: Linker Sequence
SAPRLQH

SEQ ID NO: 1045 - protein, 7 aa, Unknown
  Description of Unknown: Linker Sequence
YIPDFGG

SEQ ID NO: 1046 - protein, 8 aa, Unknown
  Description of Unknown: Linker Sequence
SLPNYLAP

SEQ ID NO: 1047 - protein, 9 aa, Unknown
  Description of Unknown: Linker Sequence
LDGKFADNV

SEQ ID NO: 1048 - protein, 9 aa, Unknown
  Description of Unknown: Linker Sequence
VINNVNADP

SEQ ID NO: 1049 - protein, 10 aa, Unknown
  Description of Unknown: Linker Sequence
QTQHALEKLS

SEQ ID NO: 1050 - protein, 11 aa, Unknown
  Description of Unknown: Linker Sequence
EGKVFKTRHTG

SEQ ID NO: 1051 - protein, 11 aa, Unknown
  Description of Unknown: Linker Sequence
VKADSEGQPGP

SEQ ID NO: 1052 - protein, 12 aa, Unknown
  Description of Unknown: Linker Sequence
RAFVYHPDIEDR

SEQ ID NO: 1053 - protein, 13 aa, Unknown
  Description of Unknown: Linker Sequence
AFGDVDTADPLDP

SEQ ID NO: 1054 - protein, 13 aa, Unknown
  Description of Unknown: Linker Sequence
LKTETHARGEGST

SEQ ID NO: 1055 - protein, 16 aa, Unknown
  Description of Unknown: Linker Sequence
KNGPIDFQPREPFSAL

SEQ ID NO: 1056 - protein, 16 aa, Unknown
  Description of Unknown: Linker Sequence
VINPGTDRNWTGHPFV

SEQ ID NO: 1057 - protein, 17 aa, Unknown
  Description of Unknown: Linker Sequence
QITQEYFGFATHLAYQG

SEQ ID NO: 1058 - protein, 22 aa, Unknown
  Description of Unknown: Linker Sequence
NHWDNLNRVVERGYAGLSLWDW

SEQ ID NO: 1059 - protein, 15 aa, Unknown
  Description of Unknown: Linker Sequence
VGSLVSGPSFTSGEV

SEQ ID NO: 1060 - protein, 13 aa, Unknown
  Description of Unknown: Linker Sequence
ITSQETDGWYTLA

SEQ ID NO: 1061 - protein, 21 aa, Unknown
  Description of Unknown: Linker Sequence
RNKEGQDVNEQGQPIRGRTQD

SEQ ID NO: 1062 - protein, 5 aa, Unknown
  Description of Unknown: Linker Sequence
HFQPF

SEQ ID NO: 1063 - protein, 5 aa, Unknown
  Description of Unknown: Linker Sequence
TGTPV

SEQ ID NO: 1064 - protein, 7 aa, Unknown
  Description of Unknown: Linker Sequence
PLSHFDA

SEQ ID NO: 1065 - protein, 4 aa, Unknown
  Description of Unknown: Linker Sequence
FNPI

SEQ ID NO: 1066 - protein, 4 aa, Unknown
  Description of Unknown: Linker Sequence
KNGS

SEQ ID NO: 1067 - protein, 5 aa, Unknown
  Description of Unknown: Linker Sequence
DRFQG

SEQ ID NO: 1068 - protein, 5 aa, Unknown
  Description of Unknown: Linker Sequence
EVPDI

SEQ ID NO: 1069 - protein, 6 aa, Unknown
  Description of Unknown: Linker Sequence
ACELHT

SEQ ID NO: 1070 - protein, 6 aa, Unknown
  Description of Unknown: Linker Sequence
LPATLT

SEQ ID NO: 1071 - protein, 6 aa, Unknown
  Description of Unknown: Linker Sequence
LPDPYG

SEQ ID NO: 1072 - protein, 6 aa, Unknown
  Description of Unknown: Linker Sequence
LPHAQP

SEQ ID NO: 1073 - protein, 6 aa, Unknown
  Description of Unknown: Linker Sequence
RQQASF

SEQ ID NO: 1074 - protein, 6 aa, Unknown
  Description of Unknown: Linker Sequence
YIGGNL

SEQ ID NO: 1075 - protein, 7 aa, Unknown
  Description of Unknown: Linker Sequence
FGRTCKE

SEQ ID NO: 1076 - protein, 7 aa, Unknown
  Description of Unknown: Linker Sequence
VDKGDNV

SEQ ID NO: 1077 - protein, 7 aa, Unknown
  Description of Unknown: Linker Sequence
WGPECNH

SEQ ID NO: 1078 - protein, 8 aa, Unknown
  Description of Unknown: Linker Sequence
VRRCEAQK

SEQ ID NO: 1079 - protein, 9 aa, Unknown
  Description of Unknown: Linker Sequence
KVLIKEEDA

SEQ ID NO: 1080 - protein, 9 aa, Unknown
  Description of Unknown: Linker Sequence
SCATGWKGL

SEQ ID NO: 1081 - protein, 10 aa, Unknown
  Description of Unknown: Linker Sequence
IVDLPDHIEV

SEQ ID NO: 1082 - protein, 10 aa, Unknown
  Description of Unknown: Linker Sequence
LCTACMNNGV

SEQ ID NO: 1083 - protein, 13 aa, Unknown
  Description of Unknown: Linker Sequence
RCSGQEGCKSYVF

SEQ ID NO: 1084 - protein, 22 aa, Unknown
  Description of Unknown: Linker Sequence
LCSPGWQGLQCEREGIPRMTPK

SEQ ID NO: 1085 - protein, 25 aa, Unknown
  Description of Unknown: Linker Sequence
CNEACHPGFYGPDCKLRCSCNNGEM

SEQ ID NO: 1086 - protein, 4 aa, Unknown
  Description of Unknown: Linker Sequence
LKTP

SEQ ID NO: 1087 - protein, 14 aa, Unknown
  Description of Unknown: Linker Sequence
AKGRRAEDGSVIDY

SEQ ID NO: 1088 - protein, 12 aa, Unknown
  Description of Unknown: Linker Sequence
AARPLRVHRRPL

SEQ ID NO: 1089 - protein, 4 aa, Unknown
  Description of Unknown: Linker Sequence
LIPL

SEQ ID NO: 1090 - protein, 5 aa, Unknown
  Description of Unknown: Linker Sequence
FGEGA

SEQ ID NO: 1091 - protein, 6 aa, Unknown
  Description of Unknown: Linker Sequence
AFDDAK

SEQ ID NO: 1092 - protein, 6 aa, Unknown
  Description of Unknown: Linker Sequence
KVNGKR

SEQ ID NO: 1093 - protein, 7 aa, Unknown
  Description of Unknown: Linker Sequence
LSKTGMP

SEQ ID NO: 1094 - protein, 8 aa, Unknown
  Description of Unknown: Linker Sequence
VLPYPRMR

SEQ ID NO: 1095 - protein, 8 aa, Unknown
  Description of Unknown: Linker Sequence
VRADDGLL

SEQ ID NO: 1096 - protein, 16 aa, Unknown
  Description of Unknown: Linker Sequence
EAEDDFKIEKPTKEDA

SEQ ID NO: 1097 - protein, 5 aa, Unknown
  Description of Unknown: Linker Sequence
IRFGR

SEQ ID NO: 1098 - protein, 6 aa, Unknown
  Description of Unknown: Linker Sequence
QTETHV

SEQ ID NO: 1099 - protein, 13 aa, Unknown
  Description of Unknown: Linker Sequence
PLKGRYTPSVGDV

SEQ ID NO: 1100 - protein, 7 aa, Unknown
  Description of Unknown: Linker Sequence
KNPALSD

SEQ ID NO: 1101 - protein, 12 aa, Unknown
  Description of Unknown: Linker Sequence
RFGSSEIGKGKK

SEQ ID NO: 1102 - protein, 14 aa, Unknown
  Description of Unknown: Linker Sequence
GKFSGRKGTWVGFT

SEQ ID NO: 1103 - protein, 9 aa, Unknown
  Description of Unknown: Linker Sequence
QFFMSDKPL

SEQ ID NO: 1104 - protein, 11 aa, Unknown
  Description of Unknown: Linker Sequence
HAPRDMGPQPR

SEQ ID NO: 1105 - protein, 12 aa, Unknown
  Description of Unknown: Linker Sequence
HFKPAPWNGLPA

SEQ ID NO: 1106 - protein, 6 aa, Unknown
  Description of Unknown: Linker Sequence
ATKASK

SEQ ID NO: 1107 - protein, 7 aa, Unknown
  Description of Unknown: Linker Sequence
ATKGATK

SEQ ID NO: 1108 - protein, 7 aa, Unknown
  Description of Unknown: Linker Sequence
IAKAFKN

SEQ ID NO: 1109 - protein, 14 aa, Unknown
  Description of Unknown: Linker Sequence
VRGSPAINVAVHVF

SEQ ID NO: 1110 - protein, 18 aa, Unknown
  Description of Unknown: Linker Sequence
GSTSGSGKPGSGEGSTKG

SEQ ID NO: 1111 - protein, 18 aa, Unknown
  Description of Unknown: Linker Sequence
KESGSVSSEQLAQFRSLD

SEQ ID NO: 1112 - protein, 6 aa, Unknown
  Description of Unknown: Linker Sequence
LDPPKQ

SEQ ID NO: 1113 - protein, 6 aa, Unknown
  Description of Unknown: Linker Sequence
TATADD

SEQ ID NO: 1114 - protein, 7 aa, Unknown
  Description of Unknown: Linker Sequence
AEAQTCR

SEQ ID NO: 1115 - protein, 7 aa, Unknown
  Description of Unknown: Linker Sequence
EEKPQGQ

SEQ ID NO: 1116 - protein, 7 aa, Unknown
  Description of Unknown: Linker Sequence
LGLNDPL

SEQ ID NO: 1117 - protein, 7 aa, Unknown
  Description of Unknown: Linker Sequence
RFPTLPF

SEQ ID NO: 1118 - protein, 9 aa, Unknown
  Description of Unknown: Linker Sequence
ISSFDRPNI

SEQ ID NO: 1119 - protein, 13 aa, Unknown
  Description of Unknown: Linker Sequence
YFGEGRQEPCGNC

SEQ ID NO: 1120 - protein, 7 aa, Unknown
  Description of Unknown: Linker Sequence
LGLNRKW

SEQ ID NO: 1121 - protein, 12 aa, Unknown
  Description of Unknown: Linker Sequence
YFGSYGTRGVGY

SEQ ID NO: 1122 - protein, 4 aa, Unknown
  Description of Unknown: Linker Sequence
NIKG

SEQ ID NO: 1123 - protein, 5 aa, Unknown
  Description of Unknown: Linker Sequence
NPVPQ

SEQ ID NO: 1124 - protein, 6 aa, Unknown
  Description of Unknown: Linker Sequence
AKFPAD

SEQ ID NO: 1125 - protein, 6 aa, Unknown
  Description of Unknown: Linker Sequence
IQNVDF

SEQ ID NO: 1126 - protein, 6 aa, Unknown
  Description of Unknown: Linker Sequence
LTGQMV

SEQ ID NO: 1127 - protein, 8 aa, Unknown
  Description of Unknown: Linker Sequence
AAEDARQY

SEQ ID NO: 1128 - protein, 16 aa, Unknown
  Description of Unknown: Linker Sequence
KLDGSQTSKWLSSEPL

SEQ ID NO: 1129 - protein, 4 aa, Unknown
  Description of Unknown: Linker Sequence
DIFK

SEQ ID NO: 1130 - protein, 4 aa, Unknown
  Description of Unknown: Linker Sequence
LPGM

SEQ ID NO: 1131 - protein, 6 aa, Unknown
  Description of Unknown: Linker Sequence
IPGNGG

SEQ ID NO: 1132 - protein, 6 aa, Unknown
  Description of Unknown: Linker Sequence
VEDWVE

SEQ ID NO: 1133 - protein, 15 aa, Unknown
  Description of Unknown: Linker Sequence
RLKADETYTSPEDYF

SEQ ID NO: 1134 - protein, 5 aa, Unknown
  Description of Unknown: Linker Sequence
RKPTE

SEQ ID NO: 1135 - protein, 6 aa, Unknown
  Description of Unknown: Linker Sequence
YARTIV

SEQ ID NO: 1136 - protein, 4 aa, Unknown
  Description of Unknown: Linker Sequence
REDG

SEQ ID NO: 1137 - protein, 4 aa, Unknown
  Description of Unknown: Linker Sequence
YKTL

SEQ ID NO: 1138 - protein, 6 aa, Unknown
  Description of Unknown: Linker Sequence
DRAKRI

SEQ ID NO: 1139 - protein, 11 aa, Unknown
  Description of Unknown: Linker Sequence
KAPQTEPPASI

SEQ ID NO: 1140 - protein, 21 aa, Unknown
  Description of Unknown: Linker Sequence
AAQSDRPAHAQGVPLTRIERT

SEQ ID NO: 1141 - protein, 8 aa, Unknown
  Description of Unknown: Linker Sequence
DWDKDADP

SEQ ID NO: 1142 - protein, 14 aa, Unknown
  Description of Unknown: Linker Sequence
LFDRHVSSSVRLND

SEQ ID NO: 1143 - protein, 26 aa, Unknown
  Description of Unknown: Linker Sequence
LVEESSRQLPTAAPEPAKVDQDAGRL

SEQ ID NO: 1144 - protein, 6 aa, Unknown
  Description of Unknown: Linker Sequence
LLGVTP

SEQ ID NO: 1145 - protein, 4 aa, Unknown
  Description of Unknown: Linker Sequence
DTLP

SEQ ID NO: 1146 - protein, 4 aa, Unknown
  Description of Unknown: Linker Sequence
ENGL

SEQ ID NO: 1147 - protein, 4 aa, Unknown
  Description of Unknown: Linker Sequence
FREV

SEQ ID NO: 1148 - protein, 4 aa, Unknown
  Description of Unknown: Linker Sequence
KVSP

SEQ ID NO: 1149 - protein, 4 aa, Unknown
  Description of Unknown: Linker Sequence
LDGK

SEQ ID NO: 1150 - protein, 4 aa, Unknown
  Description of Unknown: Linker Sequence
LNGK

SEQ ID NO: 1151 - protein, 4 aa, Unknown
  Description of Unknown: Linker Sequence
PLLI

SEQ ID NO: 1152 - protein, 4 aa, Unknown
  Description of Unknown: Linker Sequence
SGQT

SEQ ID NO: 1153 - protein, 5 aa, Unknown
  Description of Unknown: Linker Sequence
KNPRG

SEQ ID NO: 1154 - protein, 5 aa, Unknown
  Description of Unknown: Linker Sequence
KPTTQ

SEQ ID NO: 1155 - protein, 5 aa, Unknown
  Description of Unknown: Linker Sequence
SLKWK

SEQ ID NO: 1156 - protein, 5 aa, Unknown
  Description of Unknown: Linker Sequence
TSEMD

SEQ ID NO: 1157 - protein, 6 aa, Unknown
  Description of Unknown: Linker Sequence
LSGQEA

SEQ ID NO: 1158 - protein, 9 aa, Unknown
  Description of Unknown: Linker Sequence
PLDVAPQGK

SEQ ID NO: 1159 - protein, 11 aa, Unknown
  Description of Unknown: Linker Sequence
AKNTYDDSAWT

SEQ ID NO: 1160 - protein, 12 aa, Unknown
  Description of Unknown: Linker Sequence
ELPELPQPESAG

SEQ ID NO: 1161 - protein, 12 aa, Unknown
  Description of Unknown: Linker Sequence
QPNATAWSEAGH

SEQ ID NO: 1162 - protein, 12 aa, Unknown
  Description of Unknown: Linker Sequence
SEYLFRHSDNEL

SEQ ID NO: 1163 - protein, 13 aa, Unknown
  Description of Unknown: Linker Sequence
VAYTAPKVQLPSL

SEQ ID NO: 1164 - protein, 15 aa, Unknown
  Description of Unknown: Linker Sequence
NLSVTLPAASHAIPH

SEQ ID NO: 1165 - protein, 16 aa, Unknown
  Description of Unknown: Linker Sequence
IDNMGLDEDWTIGSED

SEQ ID NO: 1166 - protein, 23 aa, Unknown
  Description of Unknown: Linker Sequence
TGNLGGENYRDTVRGPLNEGGLY

SEQ ID NO: 1167 - protein, 10 aa, Unknown
  Description of Unknown: Linker Sequence
SNADLQTLPA

SEQ ID NO: 1168 - protein, 11 aa, Unknown
  Description of Unknown: Linker Sequence
LRGKIVPTPMQ

SEQ ID NO: 1169 - protein, 12 aa, Unknown
  Description of Unknown: Linker Sequence
KGGVAYRLPVPG

SEQ ID NO: 1170 - protein, 11 aa, Unknown
  Description of Unknown: Linker Sequence
QAWATAPYAPT

SEQ ID NO: 1171 - protein, 7 aa, Unknown
  Description of Unknown: Linker Sequence
YSKGVSQ

SEQ ID NO: 1172 - protein, 6 aa, Unknown
  Description of Unknown: Linker Sequence
QKGRVL

SEQ ID NO: 1173 - protein, 6 aa, Unknown
  Description of Unknown: Linker Sequence
VLGKEL

SEQ ID NO: 1174 - protein, 4 aa, Unknown
  Description of Unknown: Linker Sequence
ANTP

SEQ ID NO: 1175 - protein, 4 aa, Unknown
  Description of Unknown: Linker Sequence
DAPT

SEQ ID NO: 1176 - protein, 5 aa, Unknown
  Description of Unknown: Linker Sequence
LDPIK

SEQ ID NO: 1177 - protein, 5 aa, Unknown
  Description of Unknown: Linker Sequence
TTDFQ

SEQ ID NO: 1178 - protein, 6 aa, Unknown
  Description of Unknown: Linker Sequence
PWNKEV

SEQ ID NO: 1179 - protein, 6 aa, Unknown
  Description of Unknown: Linker Sequence
QQLLPP

SEQ ID NO: 1180 - protein, 8 aa, Unknown
  Description of Unknown: Linker Sequence
TDPQTGKT

SEQ ID NO: 1181 - protein, 9 aa, Unknown
  Description of Unknown: Linker Sequence
GRHGIVPTR

SEQ ID NO: 1182 - protein, 9 aa, Unknown
  Description of Unknown: Linker Sequence
TADGSWFFK

SEQ ID NO: 1183 - protein, 12 aa, Unknown
  Description of Unknown: Linker Sequence
LFSMGVTRGKWG

SEQ ID NO: 1184 - protein, 18 aa, Unknown
  Description of Unknown: Linker Sequence
LAPGMGEDGELEETGVPA

SEQ ID NO: 1185 - protein, 21 aa, Unknown
  Description of Unknown: Linker Sequence
CWVMHPGESWHGFKDIPDNWS

SEQ ID NO: 1186 - protein, 7 aa, Unknown
  Description of Unknown: Linker Sequence
EVHVRGH

SEQ ID NO: 1187 - protein, 17 aa, Unknown
  Description of Unknown: Linker Sequence
VGDPGPICRPWECCDKA

SEQ ID NO: 1188 - protein, 7 aa, Unknown
  Description of Unknown: Linker Sequence
KYEIPEG

SEQ ID NO: 1189 - protein, 7 aa, Unknown
  Description of Unknown: Linker Sequence
RKVCEQE

SEQ ID NO: 1190 - protein, 12 aa, Unknown
  Description of Unknown: Linker Sequence
EQLLPKLFDGCY

SEQ ID NO: 1191 - protein, 5 aa, Unknown
  Description of Unknown: Linker Sequence
SLHFS

SEQ ID NO: 1192 - protein, 6 aa, Unknown
  Description of Unknown: Linker Sequence
VYPLQW

SEQ ID NO: 1193 - protein, 7 aa, Unknown
  Description of Unknown: Linker Sequence
KTVSGLY

SEQ ID NO: 1194 - protein, 12 aa, Unknown
  Description of Unknown: Linker Sequence
SDPAFQPPCSEV

SEQ ID NO: 1195 - protein, 13 aa, Unknown
  Description of Unknown: Linker Sequence
SVVKPIGLAPLVY

SEQ ID NO: 1196 - protein, 30 aa, Unknown
  Description of Unknown: Linker Sequence
ARWHSRLGFFRDPRPFPLPLSSLFSDGGNV

SEQ ID NO: 1197 - protein, 15 aa, Unknown
  Description of Unknown: Linker Sequence
ELRSLTRHPKYKTEL

SEQ ID NO: 1198 - protein, 7 aa, Unknown
  Description of Unknown: Linker Sequence
VYNTFCI

SEQ ID NO: 1199 - protein, 4 aa, Unknown
  Description of Unknown: Linker Sequence
AATM

SEQ ID NO: 1200 - protein, 4 aa, Unknown
  Description of Unknown: Linker Sequence
FAGT

SEQ ID NO: 1201 - protein, 4 aa, Unknown
  Description of Unknown: Linker Sequence
RGDF

SEQ ID NO: 1202 - protein, 4 aa, Unknown
  Description of Unknown: Linker Sequence
SNPW

SEQ ID NO: 1203 - protein, 4 aa, Unknown
  Description of Unknown: Linker Sequence
SPDK

SEQ ID NO: 1204 - protein, 7 aa, Unknown
  Description of Unknown: Linker Sequence
KTADQQD

SEQ ID NO: 1205 - protein, 8 aa, Unknown
  Description of Unknown: Linker Sequence
QGAGAVDA

SEQ ID NO: 1206 - protein, 9 aa, Unknown
  Description of Unknown: Linker Sequence
AKQDDDSHY

SEQ ID NO: 1207 - protein, 9 aa, Unknown
  Description of Unknown: Linker Sequence
DKDNTSSKV

SEQ ID NO: 1208 - protein, 9 aa, Unknown
  Description of Unknown: Linker Sequence
NLSALEKPI

SEQ ID NO: 1209 - protein, 11 aa, Unknown
  Description of Unknown: Linker Sequence
IHRHANGKPYA

SEQ ID NO: 1210 - protein, 16 aa, Unknown
  Description of Unknown: Linker Sequence
EGVENIEDIESSEITE

SEQ ID NO: 1211 - protein, 36 aa, Unknown
  Description of Unknown: Linker Sequence
DSKDGSSYYHEANSDAKDQLDGDGLQFYALKNNFTA

SEQ ID NO: 1212 - protein, 9 aa, Unknown
  Description of Unknown: Linker Sequence
GSIQGQDLS

SEQ ID NO: 1213 - protein, 4 aa, Unknown
  Description of Unknown: Linker Sequence
RFDT

SEQ ID NO: 1214 - protein, 15 aa, Unknown
  Description of Unknown: Linker Sequence
TLTTPASNQLLALPR

SEQ ID NO: 1215 - protein, 4 aa, Unknown
  Description of Unknown: Linker Sequence
ELPF

SEQ ID NO: 1216 - protein, 7 aa, Unknown
  Description of Unknown: Linker Sequence
AGDNPDA

SEQ ID NO: 1217 - protein, 7 aa, Unknown
  Description of Unknown: Linker Sequence
VTTAEAY

SEQ ID NO: 1218 - protein, 11 aa, Unknown
  Description of Unknown: Linker Sequence
AFPGLNGMDLA

SEQ ID NO: 1219 - protein, 18 aa, Unknown
  Description of Unknown: Linker Sequence
WTQGSWTLTGGLPQAKKE

SEQ ID NO: 1220 - protein, 16 aa, Unknown
  Description of Unknown: Linker Sequence
RGIKLTKIKLDLPINF

SEQ ID NO: 1221 - protein, 4 aa, Unknown
  Description of Unknown: Linker Sequence
FLDV

SEQ ID NO: 1222 - protein, 5 aa, Unknown
  Description of Unknown: Linker Sequence
QTSLS

SEQ ID NO: 1223 - protein, 26 aa, Unknown
  Description of Unknown: Linker Sequence
YTGKWGLNDVNPEAWPRDLKGMAAVR

SEQ ID NO: 1224 - protein, 17 aa, Unknown
  Description of Unknown: Linker Sequence
VKEGAGQPDFCDGHSPA

SEQ ID NO: 1225 - protein, 9 aa, Unknown
  Description of Unknown: Linker Sequence
VDGSRGDGS

SEQ ID NO: 1226 - protein, 41 aa, Unknown
  Description of Unknown: Linker Sequence
LKARVGSADDAKKDAAKKDDAKKDDAKKDGSQTNKAKNLVQ

SEQ ID NO: 1227 - protein, 7 aa, Unknown
  Description of Unknown: Linker Sequence
VAKEGET

SEQ ID NO: 1228 - protein, 14 aa, Unknown
  Description of Unknown: Linker Sequence
TMKNTGRNVNDRPV

SEQ ID NO: 1229 - protein, 4 aa, Unknown
  Description of Unknown: Linker Sequence
EVND

SEQ ID NO: 1230 - protein, 4 aa, Unknown
  Description of Unknown: Linker Sequence
NSDG

SEQ ID NO: 1231 - protein, 4 aa, Unknown
  Description of Unknown: Linker Sequence
TPYG

SEQ ID NO: 1232 - protein, 5 aa, Unknown
  Description of Unknown: Linker Sequence
GRGNP

SEQ ID NO: 1233 - protein, 5 aa, Unknown
  Description of Unknown: Linker Sequence
SENPV

SEQ ID NO: 1234 - protein, 6 aa, Unknown
  Description of Unknown: Linker Sequence
RAQMDL

SEQ ID NO: 1235 - protein, 6 aa, Unknown
  Description of Unknown: Linker Sequence
RTSRNP

SEQ ID NO: 1236 - protein, 6 aa, Unknown
  Description of Unknown: Linker Sequence
YVLNDI

SEQ ID NO: 1237 - protein, 7 aa, Unknown
  Description of Unknown: Linker Sequence
AKKDGTH

SEQ ID NO: 1238 - protein, 8 aa, Unknown
  Description of Unknown: Linker Sequence
DATHIGKL

SEQ ID NO: 1239 - protein, 8 aa, Unknown
  Description of Unknown: Linker Sequence
KQIGGDGM

SEQ ID NO: 1240 - protein, 8 aa, Unknown
  Description of Unknown: Linker Sequence
VLTIPEII

SEQ ID NO: 1241 - protein, 8 aa, Unknown
  Description of Unknown: Linker Sequence
YKFQEGQE

SEQ ID NO: 1242 - protein, 9 aa, Unknown
  Description of Unknown: Linker Sequence
NAKDDEGVL

SEQ ID NO: 1243 - protein, 9 aa, Unknown
  Description of Unknown: Linker Sequence
SYGQFEDGI

SEQ ID NO: 1244 - protein, 10 aa, Unknown
  Description of Unknown: Linker Sequence
HGHVCFQFDA

SEQ ID NO: 1245 - protein, 16 aa, Unknown
  Description of Unknown: Linker Sequence
LFNPWCEDDAVYLDNE

SEQ ID NO: 1246 - protein, 20 aa, Unknown
  Description of Unknown: Linker Sequence
GSWDNIYAYGVPPSAWTGSV

SEQ ID NO: 1247 - protein, 20 aa, Unknown
  Description of Unknown: Linker Sequence
MYGAKKPLNTEGVMKSRSNV

SEQ ID NO: 1248 - protein, 5 aa, Unknown
  Description of Unknown: Linker Sequence
CPPCP

SEQ ID NO: 1249 - protein, 6 aa, Unknown
  Description of Unknown: Linker Sequence
QPKAAP

SEQ ID NO: 1250 - protein, 25 aa, Unknown
  Description of Unknown: Linker Sequence
PPPPPASSTTFSTTRRSSTTSSSPS

SEQ ID NO: 1251 - protein, 27 aa, Unknown
  Description of Unknown: Linker Sequence
GGNPPGGNPPGTTTPRPATSTGSSPGP

SEQ ID NO: 1252 - protein, 33 aa, Unknown
  Description of Unknown: Linker Sequence
GTSTGGSTTTTASGTTSTKASTTSTSSTSTGTG

SEQ ID NO: 1253 - protein, 33 aa, Unknown
  Description of Unknown: Linker Sequence
TVSSSSVSSSHSSTSTSSSHSSSSTPPTQPTGV

SEQ ID NO: 1254 - protein, 34 aa, Unknown
  Description of Unknown: Linker Sequence
GSSGTPPSNPSSSASPTSSTAKPSSTSTASNPSG

SEQ ID NO: 1255 - protein, 41 aa, Unknown
  Description of Unknown: Linker Sequence
ASSSSSTRAASTTSRVSPTTSRSSSATPPPGSTTTRVPPVG

SEQ ID NO: 1256 - protein, 48 aa, Unknown
  Description of Unknown: Linker Sequence
PSSGGTSSSSSAAPQSTSTKASTTTSAVRTTSTATTKTTSSAPAQGTN

SEQ ID NO: 1257 - protein, 6 aa, Unknown
  Description of Unknown: Linker Sequence
ASTKGP

SEQ ID NO: 1258 - protein, 12 aa, Unknown
  Description of Unknown: Linker Sequence
TVAAPSVFIFPP

SEQ ID NO: 1259 - protein, 13 aa, Unknown
  Description of Unknown: Linker Sequence
ASTKGPSVFPLAP

SEQ ID NO: 1260 - protein, 13 aa, Unknown
  Description of Unknown: Linker Sequence
QPKAAPSVTLFPP

SEQ ID NO: 1261 - protein, 5 aa, Unknown
  Description of Unknown: Linker Sequence
RSANS

SEQ ID NO: 1262 - protein, 9 aa, Unknown
  Description of Unknown: Linker Sequence
RPAKLALPP

SEQ ID NO: 1263 - protein, 17 aa, Unknown
  Description of Unknown: Linker Sequence
SLHGFDLASEQHTVRDT

SEQ ID NO: 1264 - protein, 4 aa, Unknown
  Description of Unknown: Linker Sequence
RARI

SEQ ID NO: 1265 - protein, 11 aa, Unknown
  Description of Unknown: Linker Sequence
TKPQLGIREGM

SEQ ID NO: 1266 - protein, 21 aa, Unknown
  Description of Unknown: Linker Sequence
HKPMAAPTTLKAGPLLSSEKL

SEQ ID NO: 1267 - protein, 12 aa, Unknown
  Description of Unknown: Linker Sequence
SLPADRKPGEPV

SEQ ID NO: 1268 - protein, 6 aa, Unknown
  Description of Unknown: Linker Sequence
RRHGEY

SEQ ID NO: 1269 - protein, 7 aa, Unknown
  Description of Unknown: Linker Sequence
ANQNSAE

SEQ ID NO: 1270 - protein, 14 aa, Unknown
  Description of Unknown: Linker Sequence
LTTNLTAFFREAHH

SEQ ID NO: 1271 - protein, 4 aa, Unknown
  Description of Unknown: Linker Sequence
PNQR

SEQ ID NO: 1272 - protein, 5 aa, Unknown
  Description of Unknown: Linker Sequence
ARNDP

SEQ ID NO: 1273 - protein, 5 aa, Unknown
  Description of Unknown: Linker Sequence
LNWTR

SEQ ID NO: 1274 - protein, 6 aa, Unknown
  Description of Unknown: Linker Sequence
DAATDR

SEQ ID NO: 1275 - protein, 6 aa, Unknown
  Description of Unknown: Linker Sequence
DKASGA

SEQ ID NO: 1276 - protein, 6 aa, Unknown
  Description of Unknown: Linker Sequence
GPNGNI

SEQ ID NO: 1277 - protein, 9 aa, Unknown
  Description of Unknown: Linker Sequence
AWDNSDSSV

SEQ ID NO: 1278 - protein, 9 aa, Unknown
  Description of Unknown: Linker Sequence
LAHVGRSLI

SEQ ID NO: 1279 - protein, 9 aa, Unknown
  Description of Unknown: Linker Sequence
TKNPQRGTF

SEQ ID NO: 1280 - protein, 11 aa, Unknown
  Description of Unknown: Linker Sequence
APMPAGLETWV

SEQ ID NO: 1281 - protein, 16 aa, Unknown
  Description of Unknown: Linker Sequence
DTGTLPNLNSEVGAGW

SEQ ID NO: 1282 - protein, 18 aa, Unknown
  Description of Unknown: Linker Sequence
ANHMWNPTGAHQSSIPAL

SEQ ID NO: 1283 - protein, 4 aa, Unknown
  Description of Unknown: Linker Sequence
DATE

SEQ ID NO: 1284 - protein, 7 aa, Unknown
  Description of Unknown: Linker Sequence
RNYLINS

SEQ ID NO: 1285 - protein, 14 aa, Unknown
  Description of Unknown: Linker Sequence
SSPKNLDDKVKLSE

SEQ ID NO: 1286 - protein, 5 aa, Unknown
  Description of Unknown: Linker Sequence
QYQIV

SEQ ID NO: 1287 - protein, 8 aa, Unknown
  Description of Unknown: Linker Sequence
RWLKNASP

SEQ ID NO: 1288 - protein, 4 aa, Unknown
  Description of Unknown: Linker Sequence
GFLG

SEQ ID NO: 1289 - protein, 6 aa, Unknown
  Description of Unknown: Linker Sequence
PLGLWA

SEQ ID NO: 1290 - protein, 6 aa, Unknown
  Description of Unknown: Linker Sequence
RVLAEA

SEQ ID NO: 1291 - protein, 8 aa, Unknown
  Description of Unknown: Linker Sequence
GGIEGRGS

SEQ ID NO: 1292 - protein, 9 aa, Unknown
  Description of Unknown: Linker Sequence
RRRRRRRRR

SEQ ID NO: 1293 - protein, 10 aa, Unknown
  Description of Unknown: Linker Sequence
EDVVCCSMSY

SEQ ID NO: 1294 - protein, 10 aa, Unknown
  Description of Unknown: Linker Sequence
TRHRQPRGWE

SEQ ID NO: 1295 - protein, 10 aa, Unknown
  Description of Unknown: Linker Sequence
AGNRVRRSVG

SEQ ID NO: 1296 - protein, 12 aa, Unknown
  Description of Unknown: Linker Sequence
CRRRRRREAEAC

SEQ ID NO: 1297 - protein, 17 aa, Unknown
  Description of Unknown: Linker Sequence
VSQTSKLTRAETVFPDV

SEQ ID NO: 1298 - protein, 20 aa, Unknown
  Description of Unknown: Linker Sequence
LEAGCKNFFPRSFTSCGSLE

SEQ ID NO: 1299 - protein, 14 aa, Unknown
  Description of Unknown: Linker Sequence
NILNDRNPVVTEDV

SEQ ID NO: 1300 - protein, 5 aa, Unknown
  Description of Unknown: Linker Sequence
YTPGE

SEQ ID NO: 1301 - protein, 4 aa, Unknown
  Description of Unknown: Linker Sequence
FGTQ

SEQ ID NO: 1302 - protein, 6 aa, Unknown
  Description of Unknown: Linker Sequence
SLQSGY

SEQ ID NO: 1303 - protein, 6 aa, Unknown
  Description of Unknown: Linker Sequence
TIPANR

SEQ ID NO: 1304 - protein, 9 aa, Unknown
  Description of Unknown: Linker Sequence
KSEKGRNKF

SEQ ID NO: 1305 - protein, 7 aa, Unknown
  Description of Unknown: Linker Sequence
YFNKYSS

SEQ ID NO: 1306 - protein, 8 aa, Unknown
  Description of Unknown: Linker Sequence
YRNPSRNI

SEQ ID NO: 1307 - protein, 4 aa, Unknown
  Description of Unknown: Linker Sequence
YGLN

SEQ ID NO: 1308 - protein, 5 aa, Unknown
  Description of Unknown: Linker Sequence
IMGSV

SEQ ID NO: 1309 - protein, 5 aa, Unknown
  Description of Unknown: Linker Sequence
SGRDA

SEQ ID NO: 1310 - protein, 6 aa, Unknown
  Description of Unknown: Linker Sequence
LIEKGG

SEQ ID NO: 1311 - protein, 7 aa, Unknown
  Description of Unknown: Linker Sequence
DINNISP

SEQ ID NO: 1312 - protein, 7 aa, Unknown
  Description of Unknown: Linker Sequence
GRHVRGI

SEQ ID NO: 1313 - protein, 8 aa, Unknown
  Description of Unknown: Linker Sequence
VRGREPGD

SEQ ID NO: 1314 - protein, 6 aa, Unknown
  Description of Unknown: Linker Sequence
EMEIPE

SEQ ID NO: 1315 - protein, 6 aa, Unknown
  Description of Unknown: Linker Sequence
RMIKSA

SEQ ID NO: 1316 - protein, 4 aa, Unknown
  Description of Unknown: Linker Sequence
GFTP

SEQ ID NO: 1317 - protein, 5 aa, Unknown
  Description of Unknown: Linker Sequence
FKIDV

SEQ ID NO: 1318 - protein, 5 aa, Unknown
  Description of Unknown: Linker Sequence
NLDDP

SEQ ID NO: 1319 - protein, 11 aa, Unknown
  Description of Unknown: Linker Sequence
LQNQQDNRGNI

SEQ ID NO: 1320 - protein, 19 aa, Unknown
  Description of Unknown: Linker Sequence
NPQGQVWIEGREQQPQKNI

SEQ ID NO: 1321 - protein, 35 aa, Unknown
  Description of Unknown: Linker Sequence
RVQGPFSVIRPPLRSQRPQEEVNGLEETICSARCT

SEQ ID NO: 1322 - protein, 53 aa, Unknown
  Description of Unknown: Linker Sequence
DSSVFQPGGGSPFGEGQGQGQQGQGQGHQGQGQGQQGQQGQQGQQSQGQGFRD

SEQ ID NO: 1323 - protein, 5 aa, Unknown
  Description of Unknown: Linker Sequence
CEGSD

SEQ ID NO: 1324 - protein, 7 aa, Unknown
  Description of Unknown: Linker Sequence
VQQQETI

SEQ ID NO: 1325 - protein, 8 aa, Unknown
  Description of Unknown: Linker Sequence
KGINSKKT

SEQ ID NO: 1326 - protein, 12 aa, Unknown
  Description of Unknown: Linker Sequence
RLKLEDRQVDLT

SEQ ID NO: 1327 - protein, 8 aa, Unknown
  Description of Unknown: Linker Sequence
TDSTQIKM

SEQ ID NO: 1328 - protein, 11 aa, Unknown
  Description of Unknown: Linker Sequence
ILLQYNTEDAY

SEQ ID NO: 1329 - protein, 14 aa, Unknown
  Description of Unknown: Linker Sequence
ELVTNCFKNRYTLQ

SEQ ID NO: 1330 - protein, 23 aa, Unknown
  Description of Unknown: Linker Sequence
IKLYLGYKNKKLRVNINVPMKTE

SEQ ID NO: 1331 - protein, 24 aa, Unknown
  Description of Unknown: Linker Sequence
KSKLLVLEDENANVDEVELKPDTL

SEQ ID NO: 1332 - protein, 11 aa, Unknown
  Description of Unknown: Linker Sequence
VLTFDLAAPTV

SEQ ID NO: 1333 - protein, 27 aa, Unknown
  Description of Unknown: Linker Sequence
CPAGNFIGKTATPYTSGTPCGDCPSDC

SEQ ID NO: 1334 - protein, 8 aa, Unknown
  Description of Unknown: Linker Sequence
HLPGREAH

SEQ ID NO: 1335 - protein, 8 aa, Unknown
  Description of Unknown: Linker Sequence
YLPDAFGP

SEQ ID NO: 1336 - protein, 21 aa, Unknown
  Description of Unknown: Linker Sequence
LEIKTLLMDEQDHGYALTGDA

SEQ ID NO: 1337 - protein, 7 aa, Unknown
  Description of Unknown: Linker Sequence
VLAMAKV

SEQ ID NO: 1338 - protein, 4 aa, Unknown
  Description of Unknown: Linker Sequence
FAFG

SEQ ID NO: 1339 - protein, 4 aa, Unknown
  Description of Unknown: Linker Sequence
GPNQ

SEQ ID NO: 1340 - protein, 8 aa, Unknown
  Description of Unknown: Linker Sequence
DEINNPSL

SEQ ID NO: 1341 - protein, 24 aa, Unknown
  Description of Unknown: Linker Sequence
VIPAGKLERVDPTTVRQEGPWADP

SEQ ID NO: 1342 - protein, 15 aa, Unknown
  Description of Unknown: Linker Sequence
LGVSSSEVSRVEADS

SEQ ID NO: 1343 - protein, 6 aa, Unknown
  Description of Unknown: Linker Sequence
AIPDFG

SEQ ID NO: 1344 - protein, 6 aa, Unknown
  Description of Unknown: Linker Sequence
VDPAYR

SEQ ID NO: 1345 - protein, 6 aa, Unknown
  Description of Unknown: Linker Sequence
YAPSSP

SEQ ID NO: 1346 - protein, 23 aa, Unknown
  Description of Unknown: Linker Sequence
ATPQMEEDKGPINHPQYPGDVGL

SEQ ID NO: 1347 - protein, 4 aa, Unknown
  Description of Unknown: Linker Sequence
IWEP

SEQ ID NO: 1348 - protein, 6 aa, Unknown
  Description of Unknown: Linker Sequence
RTDIQT

SEQ ID NO: 1349 - protein, 13 aa, Unknown
  Description of Unknown: Linker Sequence
KIPFTANKFEKNY

SEQ ID NO: 1350 - protein, 10 aa, Unknown
  Description of Unknown: Linker Sequence
LEGDKNALNQ

SEQ ID NO: 1351 - protein, 4 aa, Unknown
  Description of Unknown: Linker Sequence
AGGD

SEQ ID NO: 1352 - protein, 4 aa, Unknown
  Description of Unknown: Linker Sequence
KADV

SEQ ID NO: 1353 - protein, 4 aa, Unknown
  Description of Unknown: Linker Sequence
KGGR

SEQ ID NO: 1354 - protein, 4 aa, Unknown
  Description of Unknown: Linker Sequence
LGTF

SEQ ID NO: 1355 - protein, 4 aa, Unknown
  Description of Unknown: Linker Sequence
LPFL

SEQ ID NO: 1356 - protein, 4 aa, Unknown
  Description of Unknown: Linker Sequence
QKGK

SEQ ID NO: 1357 - protein, 5 aa, Unknown
  Description of Unknown: Linker Sequence
EEKCE

SEQ ID NO: 1358 - protein, 5 aa, Unknown
  Description of Unknown: Linker Sequence
LGAGD

SEQ ID NO: 1359 - protein, 5 aa, Unknown
  Description of Unknown: Linker Sequence
LKSIE

SEQ ID NO: 1360 - protein, 5 aa, Unknown
  Description of Unknown: Linker Sequence
PKTDD

SEQ ID NO: 1361 - protein, 5 aa, Unknown
  Description of Unknown: Linker Sequence
SAFGS

SEQ ID NO: 1362 - protein, 5 aa, Unknown
  Description of Unknown: Linker Sequence
VLRDP

SEQ ID NO: 1363 - protein, 6 aa, Unknown
  Description of Unknown: Linker Sequence
EEGYKA

SEQ ID NO: 1364 - protein, 6 aa, Unknown
  Description of Unknown: Linker Sequence
KDLGVK

SEQ ID NO: 1365 - protein, 6 aa, Unknown
  Description of Unknown: Linker Sequence
LVDISV

SEQ ID NO: 1366 - protein, 6 aa, Unknown
  Description of Unknown: Linker Sequence
NIRAVP

SEQ ID NO: 1367 - protein, 6 aa, Unknown
  Description of Unknown: Linker Sequence
RCGARR

SEQ ID NO: 1368 - protein, 6 aa, Unknown
  Description of Unknown: Linker Sequence
VFRKGF

SEQ ID NO: 1369 - protein, 6 aa, Unknown
  Description of Unknown: Linker Sequence
VIGKAL

SEQ ID NO: 1370 - protein, 7 aa, Unknown
  Description of Unknown: Linker Sequence
IGIGLPE

SEQ ID NO: 1371 - protein, 7 aa, Unknown
  Description of Unknown: Linker Sequence
QDETGKW

SEQ ID NO: 1372 - protein, 7 aa, Unknown
  Description of Unknown: Linker Sequence
VGMANTT

SEQ ID NO: 1373 - protein, 8 aa, Unknown
  Description of Unknown: Linker Sequence
ELSNIEQV

SEQ ID NO: 1374 - protein, 10 aa, Unknown
  Description of Unknown: Linker Sequence
FQGLTQDQGF

SEQ ID NO: 1375 - protein, 12 aa, Unknown
  Description of Unknown: Linker Sequence
CGKSLSENEITL

SEQ ID NO: 1376 - protein, 14 aa, Unknown
  Description of Unknown: Linker Sequence
LQGWDGQSPGTESH

SEQ ID NO: 1377 - protein, 17 aa, Unknown
  Description of Unknown: Linker Sequence
PVPRIAELMGKKLPNFG

SEQ ID NO: 1378 - protein, 18 aa, Unknown
  Description of Unknown: Linker Sequence
QYGASVSAKPELPLFYTP

SEQ ID NO: 1379 - protein, 18 aa, Unknown
  Description of Unknown: Linker Sequence
SKAGMCACHSPLPSIRGA

SEQ ID NO: 1380 - protein, 23 aa, Unknown
  Description of Unknown: Linker Sequence
EQNAAFPPLERKPFIPKKPIPAI

SEQ ID NO: 1381 - protein, 28 aa, Unknown
  Description of Unknown: Linker Sequence
EALSPIKFNRWDLPEVDPETMQTSEPWV

SEQ ID NO: 1382 - protein, 7 aa, Unknown
  Description of Unknown: Linker Sequence
NTGSGKR

SEQ ID NO: 1383 - protein, 7 aa, Unknown
  Description of Unknown: Linker Sequence
TQPVQSS

SEQ ID NO: 1384 - protein, 7 aa, Unknown
  Description of Unknown: Linker Sequence
YTGDNCA

SEQ ID NO: 1385 - protein, 18 aa, Unknown
  Description of Unknown: Linker Sequence
LPRDGLKDPQGKPLHYDR

SEQ ID NO: 1386 - protein, 7 aa, Unknown
  Description of Unknown: Linker Sequence
DDDRIKD

SEQ ID NO: 1387 - protein, 7 aa, Unknown
  Description of Unknown: Linker Sequence
EAEKNQQ

SEQ ID NO: 1388 - protein, 11 aa, Unknown
  Description of Unknown: Linker Sequence
NHLGIDLGETP

SEQ ID NO: 1389 - protein, 13 aa, Unknown
  Description of Unknown: Linker Sequence
RLFESSGCAGKLA

SEQ ID NO: 1390 - protein, 13 aa, Unknown
  Description of Unknown: Linker Sequence
VRHDGRHAHDYDY

SEQ ID NO: 1391 - protein, 15 aa, Unknown
  Description of Unknown: Linker Sequence
RDIEADTPARYNADP

SEQ ID NO: 1392 - protein, 4 aa, Unknown
  Description of Unknown: Linker Sequence
LSSR

SEQ ID NO: 1393 - protein, 4 aa, Unknown
  Description of Unknown: Linker Sequence
SILM

SEQ ID NO: 1394 - protein, 5 aa, Unknown
  Description of Unknown: Linker Sequence
DTSGG

SEQ ID NO: 1395 - protein, 5 aa, Unknown
  Description of Unknown: Linker Sequence
LGDGA

SEQ ID NO: 1396 - protein, 6 aa, Unknown
  Description of Unknown: Linker Sequence
ANNSTL

SEQ ID NO: 1397 - protein, 6 aa, Unknown
  Description of Unknown: Linker Sequence
IDEIQK

SEQ ID NO: 1398 - protein, 6 aa, Unknown
  Description of Unknown: Linker Sequence
KLPSFE

SEQ ID NO: 1399 - protein, 6 aa, Unknown
  Description of Unknown: Linker Sequence
QEVSQC

SEQ ID NO: 1400 - protein, 6 aa, Unknown
  Description of Unknown: Linker Sequence
RSLSTT

SEQ ID NO: 1401 - protein, 6 aa, Unknown
  Description of Unknown: Linker Sequence
SSNHKL

SEQ ID NO: 1402 - protein, 6 aa, Unknown
  Description of Unknown: Linker Sequence
TFESSH

SEQ ID NO: 1403 - protein, 7 aa, Unknown
  Description of Unknown: Linker Sequence
TALRPSA

SEQ ID NO: 1404 - protein, 8 aa, Unknown
  Description of Unknown: Linker Sequence
PLYESPRK

SEQ ID NO: 1405 - protein, 9 aa, Unknown
  Description of Unknown: Linker Sequence
LNSDGYPDS

SEQ ID NO: 1406 - protein, 9 aa, Unknown
  Description of Unknown: Linker Sequence
LWTDISARI

SEQ ID NO: 1407 - protein, 11 aa, Unknown
  Description of Unknown: Linker Sequence
HKEMLGGEIIP

SEQ ID NO: 1408 - protein, 12 aa, Unknown
  Description of Unknown: Linker Sequence
TLGTQPTVLRTF

SEQ ID NO: 1409 - protein, 12 aa, Unknown
  Description of Unknown: Linker Sequence
VFSNVNLKEVNY

SEQ ID NO: 1410 - protein, 13 aa, Unknown
  Description of Unknown: Linker Sequence
NVFACSDRPTVIY

SEQ ID NO: 1411 - protein, 14 aa, Unknown
  Description of Unknown: Linker Sequence
DITPLGDSNGLSPL

SEQ ID NO: 1412 - protein, 14 aa, Unknown
  Description of Unknown: Linker Sequence
FGLNIETGLLSDRK

SEQ ID NO: 1413 - protein, 29 aa, Unknown
  Description of Unknown: Linker Sequence
TQALSSSVSSSKLFSSSTAPHETSFGEEV

SEQ ID NO: 1414 - protein, 4 aa, Unknown
  Description of Unknown: Linker Sequence
EHGV

SEQ ID NO: 1415 - protein, 4 aa, Unknown
  Description of Unknown: Linker Sequence
REGK

SEQ ID NO: 1416 - protein, 5 aa, Unknown
  Description of Unknown: Linker Sequence
TVLHA

SEQ ID NO: 1417 - protein, 6 aa, Unknown
  Description of Unknown: Linker Sequence
ETEKTG

SEQ ID NO: 1418 - protein, 6 aa, Unknown
  Description of Unknown: Linker Sequence
FHYEGG

SEQ ID NO: 1419 - protein, 6 aa, Unknown
  Description of Unknown: Linker Sequence
LDSGVS

SEQ ID NO: 1420 - protein, 6 aa, Unknown
  Description of Unknown: Linker Sequence
PQAPLA

SEQ ID NO: 1421 - protein, 7 aa, Unknown
  Description of Unknown: Linker Sequence
DKRDGKE

SEQ ID NO: 1422 - protein, 8 aa, Unknown
  Description of Unknown: Linker Sequence
IHPEEGVS

SEQ ID NO: 1423 - protein, 14 aa, Unknown
  Description of Unknown: Linker Sequence
PSLETFTNVTEFEY

SEQ ID NO: 1424 - protein, 19 aa, Unknown
  Description of Unknown: Linker Sequence
GGKFDDNSYKVSGGLHGVG

SEQ ID NO: 1425 - protein, 5 aa, Unknown
  Description of Unknown: Linker Sequence
MKPEN

SEQ ID NO: 1426 - protein, 6 aa, Unknown
  Description of Unknown: Linker Sequence
TNISRA

SEQ ID NO: 1427 - protein, 7 aa, Unknown
  Description of Unknown: Linker Sequence
LLESGRL

SEQ ID NO: 1428 - protein, 15 aa, Unknown
  Description of Unknown: Linker Sequence
VWGTKGLANEGKVIG

SEQ ID NO: 1429 - protein, 28 aa, Unknown
  Description of Unknown: Linker Sequence
TLSQWGFFSPYGIGDNDACTINPYDGWA

SEQ ID NO: 1430 - protein, 4 aa, Unknown
  Description of Unknown: Linker Sequence
MERE

SEQ ID NO: 1431 - protein, 7 aa, Unknown
  Description of Unknown: Linker Sequence
FIDKPGI

SEQ ID NO: 1432 - protein, 8 aa, Unknown
  Description of Unknown: Linker Sequence
TLNYTCPT

SEQ ID NO: 1433 - protein, 10 aa, Unknown
  Description of Unknown: Linker Sequence
LLQERQDNLL

SEQ ID NO: 1434 - protein, 12 aa, Unknown
  Description of Unknown: Linker Sequence
QRTTLPHIRSIT

SEQ ID NO: 1435 - protein, 4 aa, Unknown
  Description of Unknown: Linker Sequence
VGGF

SEQ ID NO: 1436 - protein, 5 aa, Unknown
  Description of Unknown: Linker Sequence
AKIQI

SEQ ID NO: 1437 - protein, 5 aa, Unknown
  Description of Unknown: Linker Sequence
KEQNK

SEQ ID NO: 1438 - protein, 7 aa, Unknown
  Description of Unknown: Linker Sequence
PGPKCPF

SEQ ID NO: 1439 - protein, 9 aa, Unknown
  Description of Unknown: Linker Sequence
QLNYISIAS

SEQ ID NO: 1440 - protein, 9 aa, Unknown
  Description of Unknown: Linker Sequence
SANNIAKYD

SEQ ID NO: 1441 - protein, 16 aa, Unknown
  Description of Unknown: Linker Sequence
AIKGNIDAPQVVEGEK

SEQ ID NO: 1442 - protein, 18 aa, Unknown
  Description of Unknown: Linker Sequence
VIPQGRSHPVQPYPGAFV

SEQ ID NO: 1443 - protein, 4 aa, Unknown
  Description of Unknown: Linker Sequence
ETSR

SEQ ID NO: 1444 - protein, 5 aa, Unknown
  Description of Unknown: Linker Sequence
GVGRR

SEQ ID NO: 1445 - protein, 6 aa, Unknown
  Description of Unknown: Linker Sequence
FFLGQI

SEQ ID NO: 1446 - protein, 6 aa, Unknown
  Description of Unknown: Linker Sequence
LEGSSL

SEQ ID NO: 1447 - protein, 8 aa, Unknown
  Description of Unknown: Linker Sequence
DLSQVNEL

SEQ ID NO: 1448 - protein, 8 aa, Unknown
  Description of Unknown: Linker Sequence
KNANGDYF

SEQ ID NO: 1449 - protein, 11 aa, Unknown
  Description of Unknown: Linker Sequence
ILPLPYPNSPV

SEQ ID NO: 1450 - protein, 12 aa, Unknown
  Description of Unknown: Linker Sequence
FADPTIQSQSEI

SEQ ID NO: 1451 - protein, 13 aa, Unknown
  Description of Unknown: Linker Sequence
CGPYFANDNFSLE

SEQ ID NO: 1452 - protein, 15 aa, Unknown
  Description of Unknown: Linker Sequence
PDSPTYDKFLNPESL

SEQ ID NO: 1453 - protein, 4 aa, Unknown
  Description of Unknown: Linker Sequence
TGDL

SEQ ID NO: 1454 - protein, 6 aa, Unknown
  Description of Unknown: Linker Sequence
FDNEYE

SEQ ID NO: 1455 - protein, 7 aa, Unknown
  Description of Unknown: Linker Sequence
SLKFEGD

SEQ ID NO: 1456 - protein, 13 aa, Unknown
  Description of Unknown: Linker Sequence
VFNPEGRDLITDW

SEQ ID NO: 1457 - protein, 15 aa, Unknown
  Description of Unknown: Linker Sequence
GGNYDINSHLPLIPE

SEQ ID NO: 1458 - protein, 5 aa, Unknown
  Description of Unknown: Linker Sequence
RNEQD

SEQ ID NO: 1459 - protein, 4 aa, Unknown
  Description of Unknown: Linker Sequence
KEGK

SEQ ID NO: 1460 - protein, 5 aa, Unknown
  Description of Unknown: Linker Sequence
MEQAM

SEQ ID NO: 1461 - protein, 6 aa, Unknown
  Description of Unknown: Linker Sequence
ILRVNV

SEQ ID NO: 1462 - protein, 7 aa, Unknown
  Description of Unknown: Linker Sequence
LPDGEDP

SEQ ID NO: 1463 - protein, 7 aa, Unknown
  Description of Unknown: Linker Sequence
LSIGIRR

SEQ ID NO: 1464 - protein, 8 aa, Unknown
  Description of Unknown: Linker Sequence
DNAEPNRL

SEQ ID NO: 1465 - protein, 17 aa, Unknown
  Description of Unknown: Linker Sequence
GFVRKAILASFPEGVGI

SEQ ID NO: 1466 - protein, 4 aa, Unknown
  Description of Unknown: Linker Sequence
VDGV

SEQ ID NO: 1467 - protein, 5 aa, Unknown
  Description of Unknown: Linker Sequence
LWNGG

SEQ ID NO: 1468 - protein, 5 aa, Unknown
  Description of Unknown: Linker Sequence
RGISK

SEQ ID NO: 1469 - protein, 7 aa, Unknown
  Description of Unknown: Linker Sequence
CYVCEKW

SEQ ID NO: 1470 - protein, 7 aa, Unknown
  Description of Unknown: Linker Sequence
RDQNGNI

SEQ ID NO: 1471 - protein, 8 aa, Unknown
  Description of Unknown: Linker Sequence
RDKDKNFK

SEQ ID NO: 1472 - protein, 8 aa, Unknown
  Description of Unknown: Linker Sequence
TAGNEDTK

SEQ ID NO: 1473 - protein, 9 aa, Unknown
  Description of Unknown: Linker Sequence
ESNGRYSAL

SEQ ID NO: 1474 - protein, 11 aa, Unknown
  Description of Unknown: Linker Sequence
GSHKSDALFGK

SEQ ID NO: 1475 - protein, 18 aa, Unknown
  Description of Unknown: Linker Sequence
SKRKPSGGKPGTYNVWNF

SEQ ID NO: 1476 - protein, 4 aa, Unknown
  Description of Unknown: Linker Sequence
FYNM

SEQ ID NO: 1477 - protein, 4 aa, Unknown
  Description of Unknown: Linker Sequence
KFTW

SEQ ID NO: 1478 - protein, 6 aa, Unknown
  Description of Unknown: Linker Sequence
FITPII

SEQ ID NO: 1479 - protein, 6 aa, Unknown
  Description of Unknown: Linker Sequence
FSKKKA

SEQ ID NO: 1480 - protein, 7 aa, Unknown
  Description of Unknown: Linker Sequence
SNLDRHL

SEQ ID NO: 1481 - protein, 8 aa, Unknown
  Description of Unknown: Linker Sequence
FHSLQGND

SEQ ID NO: 1482 - protein, 8 aa, Unknown
  Description of Unknown: Linker Sequence
ITKPTKNT

SEQ ID NO: 1483 - protein, 10 aa, Unknown
  Description of Unknown: Linker Sequence
YYKGLGTSLA

SEQ ID NO: 1484 - protein, 14 aa, Unknown
  Description of Unknown: Linker Sequence
QYEPGTVLDPTLKE

SEQ ID NO: 1485 - protein, 6 aa, Unknown
  Description of Unknown: Linker Sequence
LNPSSR

SEQ ID NO: 1486 - protein, 8 aa, Unknown
  Description of Unknown: Linker Sequence
QRAPPKTF

SEQ ID NO: 1487 - protein, 12 aa, Unknown
  Description of Unknown: Linker Sequence
ADAKVMKDAKTK

SEQ ID NO: 1488 - protein, 4 aa, Unknown
  Description of Unknown: Linker Sequence
LNGN

SEQ ID NO: 1489 - protein, 5 aa, Unknown
  Description of Unknown: Linker Sequence
AGEME

SEQ ID NO: 1490 - protein, 6 aa, Unknown
  Description of Unknown: Linker Sequence
MDNMGR

SEQ ID NO: 1491 - protein, 6 aa, Unknown
  Description of Unknown: Linker Sequence
SREYKK

SEQ ID NO: 1492 - protein, 6 aa, Unknown
  Description of Unknown: Linker Sequence
STKDVK

SEQ ID NO: 1493 - protein, 7 aa, Unknown
  Description of Unknown: Linker Sequence
KLPVKGF

SEQ ID NO: 1494 - protein, 7 aa, Unknown
  Description of Unknown: Linker Sequence
PFNGEDY

SEQ ID NO: 1495 - protein, 8 aa, Unknown
  Description of Unknown: Linker Sequence
FKMQSLDK

SEQ ID NO: 1496 - protein, 4 aa, Unknown
  Description of Unknown: Linker Sequence
TPEG

SEQ ID NO: 1497 - protein, 5 aa, Unknown
  Description of Unknown: Linker Sequence
VGPLK

SEQ ID NO: 1498 - protein, 6 aa, Unknown
  Description of Unknown: Linker Sequence
ETDADF

SEQ ID NO: 1499 - protein, 8 aa, Unknown
  Description of Unknown: Linker Sequence
IPEEDGSS

SEQ ID NO: 1500 - protein, 9 aa, Unknown
  Description of Unknown: Linker Sequence
DCTKLGTGA

SEQ ID NO: 1501 - protein, 10 aa, Unknown
  Description of Unknown: Linker Sequence
NIPNDVTKLN

SEQ ID NO: 1502 - protein, 15 aa, Unknown
  Description of Unknown: Linker Sequence
GAARPGLRLPGCVDA

SEQ ID NO: 1503 - protein, 12 aa, Unknown
  Description of Unknown: Linker Sequence
RLRRNDDEPAEM

SEQ ID NO: 1504 - protein, 4 aa, Unknown
  Description of Unknown: Linker Sequence
LDQR

SEQ ID NO: 1505 - protein, 5 aa, Unknown
  Description of Unknown: Linker Sequence
VDGNR

SEQ ID NO: 1506 - protein, 6 aa, Unknown
  Description of Unknown: Linker Sequence
PLRRFY

SEQ ID NO: 1507 - protein, 6 aa, Unknown
  Description of Unknown: Linker Sequence
YAEEDG

SEQ ID NO: 1508 - protein, 6 aa, Unknown
  Description of Unknown: Linker Sequence
YEDGRL

SEQ ID NO: 1509 - protein, 7 aa, Unknown
  Description of Unknown: Linker Sequence
RSNQGTA

SEQ ID NO: 1510 - protein, 10 aa, Unknown
  Description of Unknown: Linker Sequence
DGPASENGFL

SEQ ID NO: 1511 - protein, 14 aa, Unknown
  Description of Unknown: Linker Sequence
PRVVVGQRVRKGDL

SEQ ID NO: 1512 - protein, 16 aa, Unknown
  Description of Unknown: Linker Sequence
ELITNIGETAGVVQDI

SEQ ID NO: 1513 - protein, 20 aa, Unknown
  Description of Unknown: Linker Sequence
SDPTLPRSDRECPKCHSREN

SEQ ID NO: 1514 - protein, 5 aa, Unknown
  Description of Unknown: Linker Sequence
VEGEV

SEQ ID NO: 1515 - protein, 8 aa, Unknown
  Description of Unknown: Linker Sequence
YVPVVQEV

SEQ ID NO: 1516 - protein, 4 aa, Unknown
  Description of Unknown: Linker Sequence
YQNN

SEQ ID NO: 1517 - protein, 5 aa, Unknown
  Description of Unknown: Linker Sequence
LVVNI

SEQ ID NO: 1518 - protein, 6 aa, Unknown
  Description of Unknown: Linker Sequence
EKNFQT

SEQ ID NO: 1519 - protein, 11 aa, Unknown
  Description of Unknown: Linker Sequence
MKLVPSIPPAT

SEQ ID NO: 1520 - protein, 14 aa, Unknown
  Description of Unknown: Linker Sequence
TQPDVPFKNPDNVV

SEQ ID NO: 1521 - protein, 32 aa, Unknown
  Description of Unknown: Linker Sequence
YPEDHNEPQSVRAASSDPGEVVPSACAADEPV

SEQ ID NO: 1522 - protein, 4 aa, Unknown
  Description of Unknown: Linker Sequence
ALCL

SEQ ID NO: 1523 - protein, 4 aa, Unknown
  Description of Unknown: Linker Sequence
LLSL

SEQ ID NO: 1524 - protein, 7 aa, Unknown
  Description of Unknown: Linker Sequence
LNNVRFS

SEQ ID NO: 1525 - protein, 7 aa, Unknown
  Description of Unknown: Linker Sequence
SLCKAHL

SEQ ID NO: 1526 - protein, 8 aa, Unknown
  Description of Unknown: Linker Sequence
EHNNLVNV

SEQ ID NO: 1527 - protein, 8 aa, Unknown
  Description of Unknown: Linker Sequence
YDTGRTGR

SEQ ID NO: 1528 - protein, 11 aa, Unknown
  Description of Unknown: Linker Sequence
QHNLKQNDQPQ

SEQ ID NO: 1529 - protein, 11 aa, Unknown
  Description of Unknown: Linker Sequence
LYPNAQTGHGH

SEQ ID NO: 1530 - protein, 13 aa, Unknown
  Description of Unknown: Linker Sequence
AEVTYKHHEPTGC

SEQ ID NO: 1531 - protein, 4 aa, Unknown
  Description of Unknown: Linker Sequence
MITP

SEQ ID NO: 1532 - protein, 8 aa, Unknown
  Description of Unknown: Linker Sequence
LQHPKIIK

SEQ ID NO: 1533 - protein, 12 aa, Unknown
  Description of Unknown: Linker Sequence
REDEEMGLTTTS

SEQ ID NO: 1534 - protein, 5 aa, Unknown
  Description of Unknown: Linker Sequence
GSREE

SEQ ID NO: 1535 - protein, 4 aa, Unknown
  Description of Unknown: Linker Sequence
ENTC

SEQ ID NO: 1536 - protein, 11 aa, Unknown
  Description of Unknown: Linker Sequence
PVSGAKTFKNE

SEQ ID NO: 1537 - protein, 5 aa, Unknown
  Description of Unknown: Linker Sequence
LSQDD

SEQ ID NO: 1538 - protein, 8 aa, Unknown
  Description of Unknown: Linker Sequence
LLGADDDL

SEQ ID NO: 1539 - protein, 4 aa, Unknown
  Description of Unknown: Linker Sequence
GHGE

SEQ ID NO: 1540 - protein, 4 aa, Unknown
  Description of Unknown: Linker Sequence
PKGR

SEQ ID NO: 1541 - protein, 5 aa, Unknown
  Description of Unknown: Linker Sequence
ALPSP

SEQ ID NO: 1542 - protein, 6 aa, Unknown
  Description of Unknown: Linker Sequence
DYGVEV

SEQ ID NO: 1543 - protein, 6 aa, Unknown
  Description of Unknown: Linker Sequence
EDPSLK

SEQ ID NO: 1544 - protein, 7 aa, Unknown
  Description of Unknown: Linker Sequence
FGDGPPL

SEQ ID NO: 1545 - protein, 8 aa, Unknown
  Description of Unknown: Linker Sequence
RQEETGEL

SEQ ID NO: 1546 - protein, 8 aa, Unknown
  Description of Unknown: Linker Sequence
SVPKVPYR

SEQ ID NO: 1547 - protein, 8 aa, Unknown
  Description of Unknown: Linker Sequence
WQGEKPES

SEQ ID NO: 1548 - protein, 12 aa, Unknown
  Description of Unknown: Linker Sequence
EVPFARLPDPNV

SEQ ID NO: 1549 - protein, 4 aa, Unknown
  Description of Unknown: Linker Sequence
DIYV

SEQ ID NO: 1550 - protein, 6 aa, Unknown
  Description of Unknown: Linker Sequence
IGENIN

SEQ ID NO: 1551 - protein, 7 aa, Unknown
  Description of Unknown: Linker Sequence
AGKITDV

SEQ ID NO: 1552 - protein, 8 aa, Unknown
  Description of Unknown: Linker Sequence
KAGNVAAD

SEQ ID NO: 1553 - protein, 14 aa, Unknown
  Description of Unknown: Linker Sequence
YIPVPTRDLEKPFL

SEQ ID NO: 1554 - protein, 4 aa, Unknown
  Description of Unknown: Linker Sequence
GEHI

SEQ ID NO: 1555 - protein, 4 aa, Unknown
  Description of Unknown: Linker Sequence
EGPE

SEQ ID NO: 1556 - protein, 4 aa, Unknown
  Description of Unknown: Linker Sequence
FEWT

SEQ ID NO: 1557 - protein, 4 aa, Unknown
  Description of Unknown: Linker Sequence
KATY

SEQ ID NO: 1558 - protein, 4 aa, Unknown
  Description of Unknown: Linker Sequence
KDGV

SEQ ID NO: 1559 - protein, 4 aa, Unknown
  Description of Unknown: Linker Sequence
LLGS

SEQ ID NO: 1560 - protein, 4 aa, Unknown
  Description of Unknown: Linker Sequence
VSKS

SEQ ID NO: 1561 - protein, 7 aa, Unknown
  Description of Unknown: Linker Sequence
KAPDGRI

SEQ ID NO: 1562 - protein, 8 aa, Unknown
  Description of Unknown: Linker Sequence
RKASNKAY

SEQ ID NO: 1563 - protein, 10 aa, Unknown
  Description of Unknown: Linker Sequence
YAPILYENDH

SEQ ID NO: 1564 - protein, 4 aa, Unknown
  Description of Unknown: Linker Sequence
YSLG

SEQ ID NO: 1565 - protein, 6 aa, Unknown
  Description of Unknown: Linker Sequence
LDPQWS

SEQ ID NO: 1566 - protein, 7 aa, Unknown
  Description of Unknown: Linker Sequence
REGNGPT

SEQ ID NO: 1567 - protein, 7 aa, Unknown
  Description of Unknown: Linker Sequence
RGEQVAF

SEQ ID NO: 1568 - protein, 8 aa, Unknown
  Description of Unknown: Linker Sequence
QQPHGPYY

SEQ ID NO: 1569 - protein, 11 aa, Unknown
  Description of Unknown: Linker Sequence
LDTWPPETQNW

SEQ ID NO: 1570 - protein, 13 aa, Unknown
  Description of Unknown: Linker Sequence
CFHPASGFAWQFS

SEQ ID NO: 1571 - protein, 16 aa, Unknown
  Description of Unknown: Linker Sequence
GIQSPRPNGPMQTAAN

SEQ ID NO: 1572 - protein, 17 aa, Unknown
  Description of Unknown: Linker Sequence
IDAEEDSTRRMGFETIL

SEQ ID NO: 1573 - protein, 22 aa, Unknown
  Description of Unknown: Linker Sequence
EMPDAPLQPGWDRPETPYSPPL

SEQ ID NO: 1574 - protein, 6 aa, Unknown
  Description of Unknown: Linker Sequence
LLDAPV

SEQ ID NO: 1575 - protein, 5 aa, Unknown
  Description of Unknown: Linker Sequence
EHIDL

SEQ ID NO: 1576 - protein, 5 aa, Unknown
  Description of Unknown: Linker Sequence
FGCDK

SEQ ID NO: 1577 - protein, 7 aa, Unknown
  Description of Unknown: Linker Sequence
CDCKHTT

SEQ ID NO: 1578 - protein, 9 aa, Unknown
  Description of Unknown: Linker Sequence
LNGNDNTIK

SEQ ID NO: 1579 - protein, 10 aa, Unknown
  Description of Unknown: Linker Sequence
ISENKNDAKV

SEQ ID NO: 1580 - protein, 8 aa, Unknown
  Description of Unknown: Linker Sequence
TAACTNTS

SEQ ID NO: 1581 - protein, 4 aa, Unknown
  Description of Unknown: Linker Sequence
LTLL

SEQ ID NO: 1582 - protein, 12 aa, Unknown
  Description of Unknown: Linker Sequence
DWENWQNVGQWR

SEQ ID NO: 1583 - protein, 8 aa, Unknown
  Description of Unknown: Linker Sequence
STKNPVHA

SEQ ID NO: 1584 - protein, 5 aa, Unknown
  Description of Unknown: Linker Sequence
THRNK

SEQ ID NO: 1585 - protein, 12 aa, Unknown
  Description of Unknown: Linker Sequence
IDHVLGVPYTTV

SEQ ID NO: 1586 - protein, 4 aa, Unknown
  Description of Unknown: Linker Sequence
IDGR

SEQ ID NO: 1587 - protein, 4 aa, Unknown
  Description of Unknown: Linker Sequence
KGTQ

SEQ ID NO: 1588 - protein, 5 aa, Unknown
  Description of Unknown: Linker Sequence
ETIKG

SEQ ID NO: 1589 - protein, 6 aa, Unknown
  Description of Unknown: Linker Sequence
ECSSES

SEQ ID NO: 1590 - protein, 7 aa, Unknown
  Description of Unknown: Linker Sequence
LDPTKTI

SEQ ID NO: 1591 - protein, 8 aa, Unknown
  Description of Unknown: Linker Sequence
SKPEAEET

SEQ ID NO: 1592 - protein, 10 aa, Unknown
  Description of Unknown: Linker Sequence
ETAVTQTYGG

SEQ ID NO: 1593 - protein, 11 aa, Unknown
  Description of Unknown: Linker Sequence
FCTDHTVLVQT

SEQ ID NO: 1594 - protein, 4 aa, Unknown
  Description of Unknown: Linker Sequence
SGGT

SEQ ID NO: 1595 - protein, 6 aa, Unknown
  Description of Unknown: Linker Sequence
FNENGI

SEQ ID NO: 1596 - protein, 6 aa, Unknown
  Description of Unknown: Linker Sequence
SFLNSM

SEQ ID NO: 1597 - protein, 7 aa, Unknown
  Description of Unknown: Linker Sequence
QNTGANN

SEQ ID NO: 1598 - protein, 9 aa, Unknown
  Description of Unknown: Linker Sequence
QNGYKPGDL

SEQ ID NO: 1599 - protein, 12 aa, Unknown
  Description of Unknown: Linker Sequence
TTGTINGATAAT

SEQ ID NO: 1600 - protein, 15 aa, Unknown
  Description of Unknown: Linker Sequence
DSSDPAATAPTTAST

SEQ ID NO: 1601 - protein, 11 aa, Unknown
  Description of Unknown: Linker Sequence
AEQPGGWKGWR

SEQ ID NO: 1602 - protein, 4 aa, Unknown
  Description of Unknown: Linker Sequence
GGGS

SEQ ID NO: 1603 - protein, 4 aa, Unknown
  Description of Unknown: Linker Sequence
GGGG

SEQ ID NO: 1604 - protein, 5 aa, Unknown
  Description of Unknown: Linker Sequence
GGGGS

SEQ ID NO: 1605 - protein, 6 aa, Unknown
  Description of Unknown: Linker Sequence
GGGGGG

SEQ ID NO: 1606 - protein, 8 aa, Unknown
  Description of Unknown: Linker Sequence
GGGGGGGG

SEQ ID NO: 1607 - protein, 10 aa, Unknown
  Description of Unknown: Linker Sequence
GGGGSGGGGS

SEQ ID NO: 1608 - protein, 12 aa, Unknown
  Description of Unknown: Linker Sequence
GSAGSAAGSGEF

SEQ ID NO: 1609 - protein, 14 aa, Unknown
  Description of Unknown: Linker Sequence
EGKSSGSGSESKST

SEQ ID NO: 1610 - protein, 15 aa, Unknown
  Description of Unknown: Linker Sequence
GGGGSGGGGSGGGGS

SEQ ID NO: 1611 - protein, 18 aa, Unknown
  Description of Unknown: Linker Sequence
KESGSVSSEQLAQFRSLD

SEQ ID NO: 1612 - protein, 20 aa, Unknown
  Description of Unknown: Linker Sequence
NSGAGSGGSSGSDGASGSRD

SEQ ID NO: 1613 - protein, 20 aa, Unknown
  Description of Unknown: Linker Sequence
GGGGSGGGGSGGGGSGGGGS

SEQ ID NO: 1614 - protein, 36 aa, Unknown
  Description of Unknown: Linker Sequence
GGSGGGSEGGGSEGGGSEGGGSEGGGSEGGGSGGGS

SEQ ID NO: 1615 - protein, 36 aa, Unknown
  Description of Unknown: Linker Sequence
GGSAGGSGSGSSGGSSGASGTGTAGGTGSGSGTGSG

SEQ ID NO: 1616 - protein, 7 aa, Unknown
  Description of Unknown: Linker Sequence
VYRFDKE

SEQ ID NO: 1617 - protein, 4 aa, Unknown
  Description of Unknown: Linker Sequence
DAHG

SEQ ID NO: 1618 - protein, 4 aa, Unknown
  Description of Unknown: Linker Sequence
KGAL

SEQ ID NO: 1619 - protein, 5 aa, Unknown
  Description of Unknown: Linker Sequence
RGVEW

SEQ ID NO: 1620 - protein, 6 aa, Unknown
  Description of Unknown: Linker Sequence
VTDHDW

SEQ ID NO: 1621 - protein, 7 aa, Unknown
  Description of Unknown: Linker Sequence
SGLEVSE

SEQ ID NO: 1622 - protein, 8 aa, Unknown
  Description of Unknown: Linker Sequence
LPLPLVPQ

SEQ ID NO: 1623 - protein, 8 aa, Unknown
  Description of Unknown: Linker Sequence
VGEPEMPS

SEQ ID NO: 1624 - protein, 9 aa, Unknown
  Description of Unknown: Linker Sequence
SAILPGRFQ

SEQ ID NO: 1625 - protein, 18 aa, Unknown
  Description of Unknown: Linker Sequence
QGKCKKTCRDVFCPGSST

SEQ ID NO: 1626 - protein, 4 aa, Unknown
  Description of Unknown: Linker Sequence
EEGL

SEQ ID NO: 1627 - protein, 4 aa, Unknown
  Description of Unknown: Linker Sequence
FAGY

SEQ ID NO: 1628 - protein, 6 aa, Unknown
  Description of Unknown: Linker Sequence
NKETRK

SEQ ID NO: 1629 - protein, 7 aa, Unknown
  Description of Unknown: Linker Sequence
EKELYFK

SEQ ID NO: 1630 - protein, 7 aa, Unknown
  Description of Unknown: Linker Sequence
FQGKIKG

SEQ ID NO: 1631 - protein, 7 aa, Unknown
  Description of Unknown: Linker Sequence
MWPDADL

SEQ ID NO: 1632 - protein, 7 aa, Unknown
  Description of Unknown: Linker Sequence
VGEGFAF

SEQ ID NO: 1633 - protein, 10 aa, Unknown
  Description of Unknown: Linker Sequence
GTARASIPTY

SEQ ID NO: 1634 - protein, 13 aa, Unknown
  Description of Unknown: Linker Sequence
FTPVSKDPQSANW

SEQ ID NO: 1635 - protein, 13 aa, Unknown
  Description of Unknown: Linker Sequence
YLPKGEDGKDYSW

SEQ ID NO: 1636 - protein, 22 aa, Unknown
  Description of Unknown: Linker Sequence
WGFERDENGNPKRDETLKHPRC

SEQ ID NO: 1637 - protein, 55 aa, Unknown
  Description of Unknown: Linker Sequence
AYLYGPGREDGPLPEYYEPMECPVIEHPFSKTLHNPTALHFATEEKAVCDPRYPF

SEQ ID NO: 1638 - protein, 44 aa, Unknown
  Description of Unknown: Linker Sequence
GRLFAINKMAEGPFPEHYEPIETPLGTNPLHPNVVSNPVVRLYE

SEQ ID NO: 1639 - protein, 4 aa, Unknown
  Description of Unknown: Linker Sequence
AAQK

SEQ ID NO: 1640 - protein, 4 aa, Unknown
  Description of Unknown: Linker Sequence
EDGL

SEQ ID NO: 1641 - protein, 4 aa, Unknown
  Description of Unknown: Linker Sequence
FSGY

SEQ ID NO: 1642 - protein, 5 aa, Unknown
  Description of Unknown: Linker Sequence
TNASL

SEQ ID NO: 1643 - protein, 6 aa, Unknown
  Description of Unknown: Linker Sequence
DAEKRQ

SEQ ID NO: 1644 - protein, 7 aa, Unknown
  Description of Unknown: Linker Sequence
DEGKVTG

SEQ ID NO: 1645 - protein, 7 aa, Unknown
  Description of Unknown: Linker Sequence
ENNKINA

SEQ ID NO: 1646 - protein, 7 aa, Unknown
  Description of Unknown: Linker Sequence
VRDDFAF

SEQ ID NO: 1647 - protein, 10 aa, Unknown
  Description of Unknown: Linker Sequence
TLPSEKQVDL

SEQ ID NO: 1648 - protein, 11 aa, Unknown
  Description of Unknown: Linker Sequence
WLPKWDQTYDV

SEQ ID NO: 1649 - protein, 12 aa, Unknown
  Description of Unknown: Linker Sequence
ALRMGKKEQFPY

SEQ ID NO: 1650 - protein, 13 aa, Unknown
  Description of Unknown: Linker Sequence
NTPKATLADQVNY

SEQ ID NO: 1651 - protein, 27 aa, Unknown
  Description of Unknown: Linker Sequence
YDKSSWNYQLDENGYAKRDETLTHPRC

SEQ ID NO: 1652 - protein, 9 aa, Unknown
  Description of Unknown: Linker Sequence
HLPATIGDY

SEQ ID NO: 1653 - protein, 4 aa, Unknown
  Description of Unknown: Linker Sequence
SNRG

SEQ ID NO: 1654 - protein, 6 aa, Unknown
  Description of Unknown: Linker Sequence
DAVKGK

SEQ ID NO: 1655 - protein, 7 aa, Unknown
  Description of Unknown: Linker Sequence
LLPDGRV

SEQ ID NO: 1656 - protein, 7 aa, Unknown
  Description of Unknown: Linker Sequence
MDGNGQI

SEQ ID NO: 1657 - protein, 7 aa, Unknown
  Description of Unknown: Linker Sequence
QAGPSTA

SEQ ID NO: 1658 - protein, 7 aa, Unknown
  Description of Unknown: Linker Sequence
SDNHAWL

SEQ ID NO: 1659 - protein, 7 aa, Unknown
  Description of Unknown: Linker Sequence
VLPDGST

SEQ ID NO: 1660 - protein, 7 aa, Unknown
  Description of Unknown: Linker Sequence
YNSNGNL

SEQ ID NO: 1661 - protein, 7 aa, Unknown
  Description of Unknown: Linker Sequence
YTSGSGD

SEQ ID NO: 1662 - protein, 8 aa, Unknown
  Description of Unknown: Linker Sequence
DLPIVPAA

SEQ ID NO: 1663 - protein, 8 aa, Unknown
  Description of Unknown: Linker Sequence
IEPTSGRV

SEQ ID NO: 1664 - protein, 8 aa, Unknown
  Description of Unknown: Linker Sequence
WDPSTGIV

SEQ ID NO: 1665 - protein, 9 aa, Unknown
  Description of Unknown: Linker Sequence
EANGQPWTS

SEQ ID NO: 1666 - protein, 9 aa, Unknown
  Description of Unknown: Linker Sequence
MLTADKQGL

SEQ ID NO: 1667 - protein, 9 aa, Unknown
  Description of Unknown: Linker Sequence
VAPDAMCGN

SEQ ID NO: 1668 - protein, 10 aa, Unknown
  Description of Unknown: Linker Sequence
TLGEPGTSPN

SEQ ID NO: 1669 - protein, 12 aa, Unknown
  Description of Unknown: Linker Sequence
VTVTKHDMFCPG

SEQ ID NO: 1670 - protein, 13 aa, Unknown
  Description of Unknown: Linker Sequence
KQNPNSIVRVYHS

SEQ ID NO: 1671 - protein, 14 aa, Unknown
  Description of Unknown: Linker Sequence
FASNGLYFARTFHT

SEQ ID NO: 1672 - protein, 14 aa, Unknown
  Description of Unknown: Linker Sequence
GGGLCGDCTTNHFD

SEQ ID NO: 1673 - protein, 14 aa, Unknown
  Description of Unknown: Linker Sequence
QASSYTAPQPGLGR

SEQ ID NO: 1674 - protein, 16 aa, Unknown
  Description of Unknown: Linker Sequence
FGGSPDYQDSDATTNA

SEQ ID NO: 1675 - protein, 17 aa, Unknown
  Description of Unknown: Linker Sequence
WSSYRNDAFGGSPGGIT

SEQ ID NO: 1676 - protein, 20 aa, Unknown
  Description of Unknown: Linker Sequence
TGGQRRGIPFEDSTPVFTPE

SEQ ID NO: 1677 - protein, 10 aa, Unknown
  Description of Unknown: Linker Sequence
LIPQHTGTFR

SEQ ID NO: 1678 - protein, 11 aa, Unknown
  Description of Unknown: Linker Sequence
EPRSQPHTKPS

SEQ ID NO: 1679 - protein, 4 aa, Unknown
  Description of Unknown: Linker Sequence
KPAP

SEQ ID NO: 1680 - protein, 6 aa, Unknown
  Description of Unknown: Linker Sequence
IEGANG

SEQ ID NO: 1681 - protein, 8 aa, Unknown
  Description of Unknown: Linker Sequence
PIKNMPID

SEQ ID NO: 1682 - protein, 12 aa, Unknown
  Description of Unknown: Linker Sequence
DQPTAHPTVRDE

SEQ ID NO: 1683 - protein, 8 aa, Unknown
  Description of Unknown: Linker Sequence
LVRTLVPT

SEQ ID NO: 1684 - protein, 9 aa, Unknown
  Description of Unknown: Linker Sequence
AGAPVETPQ

SEQ ID NO: 1685 - protein, 11 aa, Unknown
  Description of Unknown: Linker Sequence
SLDAPATSLTG

SEQ ID NO: 1686 - protein, 12 aa, Unknown
  Description of Unknown: Linker Sequence
YAAGTPLSSPEL

SEQ ID NO: 1687 - protein, 4 aa, Unknown
  Description of Unknown: Linker Sequence
KVEH

SEQ ID NO: 1688 - protein, 4 aa, Unknown
  Description of Unknown: Linker Sequence
SHGQ

SEQ ID NO: 1689 - protein, 4 aa, Unknown
  Description of Unknown: Linker Sequence
VDLS

SEQ ID NO: 1690 - protein, 5 aa, Unknown
  Description of Unknown: Linker Sequence
KGLDA

SEQ ID NO: 1691 - protein, 5 aa, Unknown
  Description of Unknown: Linker Sequence
LGPNA

SEQ ID NO: 1692 - protein, 5 aa, Unknown
  Description of Unknown: Linker Sequence
LTGRI

SEQ ID NO: 1693 - protein, 6 aa, Unknown
  Description of Unknown: Linker Sequence
ITRRSV

SEQ ID NO: 1694 - protein, 6 aa, Unknown
  Description of Unknown: Linker Sequence
VKRQDI

SEQ ID NO: 1695 - protein, 7 aa, Unknown
  Description of Unknown: Linker Sequence
FDKTGAE

SEQ ID NO: 1696 - protein, 17 aa, Unknown
  Description of Unknown: Linker Sequence
ESNLQYDAGDKGIYRHY

SEQ ID NO: 1697 - protein, 5 aa, Unknown
  Description of Unknown: Linker Sequence
DIGTI

SEQ ID NO: 1698 - protein, 27 aa, Unknown
  Description of Unknown: Linker Sequence
TKKPVPDFSFYDRSAPIYTQPRYLPPS

SEQ ID NO: 1699 - protein, 4 aa, Unknown
  Description of Unknown: Linker Sequence
KTPL

SEQ ID NO: 1700 - protein, 7 aa, Unknown
  Description of Unknown: Linker Sequence
NCYGCET

SEQ ID NO: 1701 - protein, 16 aa, Unknown
  Description of Unknown: Linker Sequence
YGIDVKIPEGLEPPNE

SEQ ID NO: 1702 - protein, 6 aa, Unknown
  Description of Unknown: Linker Sequence
VGGFYN

SEQ ID NO: 1703 - protein, 7 aa, Unknown
  Description of Unknown: Linker Sequence
VLTGKAR

SEQ ID NO: 1704 - protein, 14 aa, Unknown
  Description of Unknown: Linker Sequence
FDVAESVIPSSGTF

SEQ ID NO: 1705 - protein, 5 aa, Unknown
  Description of Unknown: Linker Sequence
TLKPW

SEQ ID NO: 1706 - protein, 9 aa, Unknown
  Description of Unknown: Linker Sequence
VQNTTHLDE

SEQ ID NO: 1707 - protein, 11 aa, Unknown
  Description of Unknown: Linker Sequence
LKGEPSDMDKA

SEQ ID NO: 1708 - protein, 14 aa, Unknown
  Description of Unknown: Linker Sequence
HFPAMVSRISGIGL

SEQ ID NO: 1709 - protein, 15 aa, Unknown
  Description of Unknown: Linker Sequence
QVSRGAEHLDDLDLN

SEQ ID NO: 1710 - protein, 26 aa, Unknown
  Description of Unknown: Linker Sequence
LAQVDPGENARYCTLQGRNEVPDTLD

SEQ ID NO: 1711 - protein, 27 aa, Unknown
  Description of Unknown: Linker Sequence
YNEEVVALPVGGFYRFRKSGDRHGWEG

SEQ ID NO: 1712 - protein, 13 aa, Unknown
  Description of Unknown: Linker Sequence
HDPFTLEPYSRDP

SEQ ID NO: 1713 - protein, 13 aa, Unknown
  Description of Unknown: Linker Sequence
YTPAGEPIPTNKR

SEQ ID NO: 1714 - protein, 4 aa, Unknown
  Description of Unknown: Linker Sequence
NIPP

SEQ ID NO: 1715 - protein, 4 aa, Unknown
  Description of Unknown: Linker Sequence
RGWA

SEQ ID NO: 1716 - protein, 5 aa, Unknown
  Description of Unknown: Linker Sequence
AFETP

SEQ ID NO: 1717 - protein, 5 aa, Unknown
  Description of Unknown: Linker Sequence
DELRG

SEQ ID NO: 1718 - protein, 6 aa, Unknown
  Description of Unknown: Linker Sequence
EIPDVV

SEQ ID NO: 1719 - protein, 7 aa, Unknown
  Description of Unknown: Linker Sequence
KGGYDGR

SEQ ID NO: 1720 - protein, 7 aa, Unknown
  Description of Unknown: Linker Sequence
RRGEPHV

SEQ ID NO: 1721 - protein, 8 aa, Unknown
  Description of Unknown: Linker Sequence
LKVPRPGT

SEQ ID NO: 1722 - protein, 14 aa, Unknown
  Description of Unknown: Linker Sequence
NLDGKPLLTGKRNP

SEQ ID NO: 1723 - protein, 6 aa, Unknown
  Description of Unknown: Linker Sequence
DHSDVA

SEQ ID NO: 1724 - protein, 8 aa, Unknown
  Description of Unknown: Linker Sequence
FKPAYGSI

SEQ ID NO: 1725 - protein, 19 aa, Unknown
  Description of Unknown: Linker Sequence
AFPGTPHLLPPANSGDADA

SEQ ID NO: 1726 - protein, 12 aa, Unknown
  Description of Unknown: Linker Sequence
YGKDDKLYPKDP

SEQ ID NO: 1727 - protein, 9 aa, Unknown
  Description of Unknown: Linker Sequence
KYNLYGKDI

SEQ ID NO: 1728 - protein, 6 aa, Unknown
  Description of Unknown: Linker Sequence
LREGNL

SEQ ID NO: 1729 - protein, 6 aa, Unknown
  Description of Unknown: Linker Sequence
DCNEKL

SEQ ID NO: 1730 - protein, 6 aa, Unknown
  Description of Unknown: Linker Sequence
LYPSDP

SEQ ID NO: 1731 - protein, 6 aa, Unknown
  Description of Unknown: Linker Sequence
YGAHDA

SEQ ID NO: 1732 - protein, 9 aa, Unknown
  Description of Unknown: Linker Sequence
QFKMMGETD

SEQ ID NO: 1733 - protein, 6 aa, Unknown
  Description of Unknown: Linker Sequence
FETEYF

SEQ ID NO: 1734 - protein, 11 aa, Unknown
  Description of Unknown: Linker Sequence
TSPHDHQTHAY

SEQ ID NO: 1735 - protein, 9 aa, Unknown
  Description of Unknown: Linker Sequence
KADPKGITE

SEQ ID NO: 1736 - protein, 34 aa, Unknown
  Description of Unknown: Linker Sequence
LTAKEPTEVESVECPHIAVGVWEANEKLPETPDR

SEQ ID NO: 1737 - protein, 4 aa, Unknown
  Description of Unknown: Linker Sequence
VVPN

SEQ ID NO: 1738 - protein, 5 aa, Unknown
  Description of Unknown: Linker Sequence
LSPPV

SEQ ID NO: 1739 - protein, 7 aa, Unknown
  Description of Unknown: Linker Sequence
DVKNGEC

SEQ ID NO: 1740 - protein, 7 aa, Unknown
  Description of Unknown: Linker Sequence
KDDIVDR

SEQ ID NO: 1741 - protein, 7 aa, Unknown
  Description of Unknown: Linker Sequence
SDKKCSV

SEQ ID NO: 1742 - protein, 7 aa, Unknown
  Description of Unknown: Linker Sequence
TKVPLVA

SEQ ID NO: 1743 - protein, 9 aa, Unknown
  Description of Unknown: Linker Sequence
LAQLDNYGQ

SEQ ID NO: 1744 - protein, 12 aa, Unknown
  Description of Unknown: Linker Sequence
NYNVKSPITGND

SEQ ID NO: 1745 - protein, 85 aa, Unknown
  Description of Unknown: Linker Sequence
KPLKEPKTVNVVQFEPSKGAIGKAYKKDAKLVMEYLAICDECYITEMEMLLNEKGEFTIETEGKTFQLTKDMINVKRFQKTLYVE

SEQ ID NO: 1746 - protein, 4 aa, Unknown
  Description of Unknown: Linker Sequence
SNGG

SEQ ID NO: 1747 - protein, 13 aa, Unknown
  Description of Unknown: Linker Sequence
FSVDEIVQPDPPI

SEQ ID NO: 1748 - protein, 10 aa, Unknown
  Description of Unknown: Linker Sequence
LTPRRSRKLK

SEQ ID NO: 1749 - protein, 6 aa, Unknown
  Description of Unknown: Linker Sequence
DEPRSV

SEQ ID NO: 1750 - protein, 29 aa, Unknown
  Description of Unknown: Linker Sequence
LPTANGDGGALALDSLTVLGAGGNNANDW

SEQ ID NO: 1751 - protein, 6 aa, Unknown
  Description of Unknown: Linker Sequence
RNNLTR

SEQ ID NO: 1752 - protein, 8 aa, Unknown
  Description of Unknown: Linker Sequence
RAMTDVHQ

SEQ ID NO: 1753 - protein, 24 aa, Unknown
  Description of Unknown: Linker Sequence
TTENPELQLEPLSAPEVTEPTATD

SEQ ID NO: 1754 - protein, 6 aa, Unknown
  Description of Unknown: Linker Sequence
VPRDCG

SEQ ID NO: 1755 - protein, 7 aa, Unknown
  Description of Unknown: Linker Sequence
VRSRGPE

SEQ ID NO: 1756 - protein, 40 aa, Unknown
  Description of Unknown: Linker Sequence
QEPEFQRMSALRLAACKRKEQEHGKDRGNTPKKPRLVFTD

SEQ ID NO: 1757 - protein, 14 aa, Unknown
  Description of Unknown: Linker Sequence
AEGFGLPEEKGPDL

SEQ ID NO: 1758 - protein, 4 aa, Unknown
  Description of Unknown: Linker Sequence
KGGK

SEQ ID NO: 1759 - protein, 6 aa, Unknown
  Description of Unknown: Linker Sequence
KNQKPI

SEQ ID NO: 1760 - protein, 7 aa, Unknown
  Description of Unknown: Linker Sequence
RGTLNVS

SEQ ID NO: 1761 - protein, 9 aa, Unknown
  Description of Unknown: Linker Sequence
TVGAGLPII

SEQ ID NO: 1762 - protein, 4 aa, Unknown
  Description of Unknown: Linker Sequence
LDGE

SEQ ID NO: 1763 - protein, 4 aa, Unknown
  Description of Unknown: Linker Sequence
LGNW

SEQ ID NO: 1764 - protein, 7 aa, Unknown
  Description of Unknown: Linker Sequence
HLFPDCA

SEQ ID NO: 1765 - protein, 18 aa, Unknown
  Description of Unknown: Linker Sequence
IPKAELLTSESRGVLPDT

SEQ ID NO: 1766 - protein, 5 aa, Unknown
  Description of Unknown: Linker Sequence
ETVAP

SEQ ID NO: 1767 - protein, 6 aa, Unknown
  Description of Unknown: Linker Sequence
QGLTSF

SEQ ID NO: 1768 - protein, 7 aa, Unknown
  Description of Unknown: Linker Sequence
VSKPKME

SEQ ID NO: 1769 - protein, 5 aa, Unknown
  Description of Unknown: Linker Sequence
TVAAP

SEQ ID NO: 1770 - protein, 26 aa, Unknown
  Description of Unknown: Linker Sequence
GGNPPGGNRGTTTTRRPATTTGSSPG

SEQ ID NO: 1771 - protein, 7 aa, Unknown
  Description of Unknown: Linker Sequence
CKPCICT

SEQ ID NO: 1772 - protein, 6 aa, Unknown
  Description of Unknown: Linker Sequence
VPSEVS

SEQ ID NO: 1773 - protein, 10 aa, Unknown
  Description of Unknown: Linker Sequence
EPKSCDKTHT

SEQ ID NO: 1774 - protein, 7 aa, Unknown
  Description of Unknown: Linker Sequence
CPPCKCP

SEQ ID NO: 1775 - protein, 9 aa, Unknown
  Description of Unknown: Linker Sequence
EPRGPTIKP

SEQ ID NO: 1776 - protein, 5 aa, Unknown
  Description of Unknown: Linker Sequence
ATENE

SEQ ID NO: 1777 - protein, 6 aa, Unknown
  Description of Unknown: Linker Sequence
AKSVGI

SEQ ID NO: 1778 - protein, 7 aa, Unknown
  Description of Unknown: Linker Sequence
ATWTGDS

SEQ ID NO: 1779 - protein, 10 aa, Unknown
  Description of Unknown: Linker Sequence
ATITNANWDD

SEQ ID NO: 1780 - protein, 11 aa, Unknown
  Description of Unknown: Linker Sequence
NGKDFSEPLPE

SEQ ID NO: 1781 - protein, 6 aa, Unknown
  Description of Unknown: Linker Sequence
KQPLRR

SEQ ID NO: 1782 - protein, 8 aa, Unknown
  Description of Unknown: Linker Sequence
LSPYTESS

SEQ ID NO: 1783 - protein, 4 aa, Unknown
  Description of Unknown: Linker Sequence
VDSE

SEQ ID NO: 1784 - protein, 5 aa, Unknown
  Description of Unknown: Linker Sequence
FVTGP

SEQ ID NO: 1785 - protein, 7 aa, Unknown
  Description of Unknown: Linker Sequence
IKGDAYY

SEQ ID NO: 1786 - protein, 8 aa, Unknown
  Description of Unknown: Linker Sequence
TKSGVVHF

SEQ ID NO: 1787 - protein, 9 aa, Unknown
  Description of Unknown: Linker Sequence
VVLGEEVSF

SEQ ID NO: 1788 - protein, 12 aa, Unknown
  Description of Unknown: Linker Sequence
IVPNDAAKPYNM

SEQ ID NO: 1789 - protein, 26 aa, Unknown
  Description of Unknown: Linker Sequence
YLPSNNMEEPPYIDTGDPADRDATGV

SEQ ID NO: 1790 - protein, 4 aa, Unknown
  Description of Unknown: Linker Sequence
GALP

SEQ ID NO: 1791 - protein, 8 aa, Unknown
  Description of Unknown: Linker Sequence
FGVDWLKG

SEQ ID NO: 1792 - protein, 4 aa, Unknown
  Description of Unknown: Linker Sequence
ILPQ

SEQ ID NO: 1793 - protein, 7 aa, Unknown
  Description of Unknown: Linker Sequence
EAPLDNS

SEQ ID NO: 1794 - protein, 14 aa, Unknown
  Description of Unknown: Linker Sequence
AAERVPLANPFAGE

SEQ ID NO: 1795 - protein, 4 aa, Unknown
  Description of Unknown: Linker Sequence
EGVL

SEQ ID NO: 1796 - protein, 6 aa, Unknown
  Description of Unknown: Linker Sequence
LVKIEP

SEQ ID NO: 1797 - protein, 6 aa, Unknown
  Description of Unknown: Linker Sequence
RSLIGD

SEQ ID NO: 1798 - protein, 7 aa, Unknown
  Description of Unknown: Linker Sequence
DASAVHP

SEQ ID NO: 1799 - protein, 7 aa, Unknown
  Description of Unknown: Linker Sequence
EFPELDV

SEQ ID NO: 1800 - protein, 7 aa, Unknown
  Description of Unknown: Linker Sequence
FSDYFEH

SEQ ID NO: 1801 - protein, 7 aa, Unknown
  Description of Unknown: Linker Sequence
KVSRLGE

SEQ ID NO: 1802 - protein, 7 aa, Unknown
  Description of Unknown: Linker Sequence
NGAFRTR

SEQ ID NO: 1803 - protein, 7 aa, Unknown
  Description of Unknown: Linker Sequence
PLKSAPS

SEQ ID NO: 1804 - protein, 8 aa, Unknown
  Description of Unknown: Linker Sequence
ARISGLNS

SEQ ID NO: 1805 - protein, 10 aa, Unknown
  Description of Unknown: Linker Sequence
QRIAADTERD

SEQ ID NO: 1806 - protein, 11 aa, Unknown
  Description of Unknown: Linker Sequence
ERFGLSNQGRA

SEQ ID NO: 1807 - protein, 11 aa, Unknown
  Description of Unknown: Linker Sequence
LLAAPAGPRAT

SEQ ID NO: 1808 - protein, 12 aa, Unknown
  Description of Unknown: Linker Sequence
KVGEEAPGTLHP

SEQ ID NO: 1809 - protein, 12 aa, Unknown
  Description of Unknown: Linker Sequence
NAVGVDVNTASA

SEQ ID NO: 1810 - protein, 13 aa, Unknown
  Description of Unknown: Linker Sequence
AAGFLRVMNGDNP

SEQ ID NO: 1811 - protein, 13 aa, Unknown
  Description of Unknown: Linker Sequence
GVESLKDLKPGMV

SEQ ID NO: 1812 - protein, 13 aa, Unknown
  Description of Unknown: Linker Sequence
SIGVGQYQHDVSQ

SEQ ID NO: 1813 - protein, 17 aa, Unknown
  Description of Unknown: Linker Sequence
LDKPGRDPRPEFKTAEF

SEQ ID NO: 1814 - protein, 23 aa, Unknown
  Description of Unknown: Linker Sequence
LKRLDPKKFTDETFGLPTVTDIL

SEQ ID NO: 1815 - protein, 4 aa, Unknown
  Description of Unknown: Linker Sequence
LEGE

SEQ ID NO: 1816 - protein, 5 aa, Unknown
  Description of Unknown: Linker Sequence
RLGFK

SEQ ID NO: 1817 - protein, 9 aa, Unknown
  Description of Unknown: Linker Sequence
RGRPFEPPV

SEQ ID NO: 1818 - protein, 15 aa, Unknown
  Description of Unknown: Linker Sequence
RGEVEETLKEDLPNV

SEQ ID NO: 1819 - protein, 4 aa, Unknown
  Description of Unknown: Linker Sequence
LEYE

SEQ ID NO: 1820 - protein, 9 aa, Unknown
  Description of Unknown: Linker Sequence
SYGLPPLNA

SEQ ID NO: 1821 - protein, 5 aa, Unknown
  Description of Unknown: Linker Sequence
ILHDE

SEQ ID NO: 1822 - protein, 13 aa, Unknown
  Description of Unknown: Linker Sequence
KGWGGLPIGTEGR

SEQ ID NO: 1823 - protein, 4 aa, Unknown
  Description of Unknown: Linker Sequence
PQSP

SEQ ID NO: 1824 - protein, 6 aa, Unknown
  Description of Unknown: Linker Sequence
DGFEAL

SEQ ID NO: 1825 - protein, 6 aa, Unknown
  Description of Unknown: Linker Sequence
EQNPWK

SEQ ID NO: 1826 - protein, 6 aa, Unknown
  Description of Unknown: Linker Sequence
SEHWQR

SEQ ID NO: 1827 - protein, 9 aa, Unknown
  Description of Unknown: Linker Sequence
LDPQACPTV

SEQ ID NO: 1828 - protein, 5 aa, Unknown
  Description of Unknown: Linker Sequence
KTPLT

SEQ ID NO: 1829 - protein, 6 aa, Unknown
  Description of Unknown: Linker Sequence
LRQLTT

SEQ ID NO: 1830 - protein, 4 aa, Unknown
  Description of Unknown: Linker Sequence
QNDI

SEQ ID NO: 1831 - protein, 7 aa, Unknown
  Description of Unknown: Linker Sequence
INARAPV

SEQ ID NO: 1832 - protein, 9 aa, Unknown
  Description of Unknown: Linker Sequence
TVTHGDIDL

SEQ ID NO: 1833 - protein, 10 aa, Unknown
  Description of Unknown: Linker Sequence
TKTDVAGEAE

SEQ ID NO: 1834 - protein, 24 aa, Unknown
  Description of Unknown: Linker Sequence
LFNTNGFMLEENVVSTKPRFHFIA

SEQ ID NO: 1835 - protein, 7 aa, Unknown
  Description of Unknown: Linker Sequence
ASLDQPF

SEQ ID NO: 1836 - protein, 9 aa, Unknown
  Description of Unknown: Linker Sequence
VKPGRQYQE

SEQ ID NO: 1837 - protein, 4 aa, Unknown
  Description of Unknown: Linker Sequence
DGFE

SEQ ID NO: 1838 - protein, 5 aa, Unknown
  Description of Unknown: Linker Sequence
LRRFN

SEQ ID NO: 1839 - protein, 6 aa, Unknown
  Description of Unknown: Linker Sequence
KRTGET

SEQ ID NO: 1840 - protein, 16 aa, Unknown
  Description of Unknown: Linker Sequence
VEGEQSIPMVSRLGMK

SEQ ID NO: 1841 - protein, 22 aa, Unknown
  Description of Unknown: Linker Sequence
AEGHITTNHVAATRAAKSKVRR

SEQ ID NO: 1842 - protein, 8 aa, Unknown
  Description of Unknown: Linker Sequence
VDKSDEPL

SEQ ID NO: 1843 - protein, 7 aa, Unknown
  Description of Unknown: Linker Sequence
IVSPANE

SEQ ID NO: 1844 - protein, 11 aa, Unknown
  Description of Unknown: Linker Sequence
VENEPNLCYNA

SEQ ID NO: 1845 - protein, 13 aa, Unknown
  Description of Unknown: Linker Sequence
FITLEENKPTRPV

SEQ ID NO: 1846 - protein, 4 aa, Unknown
  Description of Unknown: Linker Sequence
EDGI

SEQ ID NO: 1847 - protein, 4 aa, Unknown
  Description of Unknown: Linker Sequence
HKLK

SEQ ID NO: 1848 - protein, 4 aa, Unknown
  Description of Unknown: Linker Sequence
KGGE

SEQ ID NO: 1849 - protein, 4 aa, Unknown
  Description of Unknown: Linker Sequence
SHSL

SEQ ID NO: 1850 - protein, 6 aa, Unknown
  Description of Unknown: Linker Sequence
WSTDIL

SEQ ID NO: 1851 - protein, 9 aa, Unknown
  Description of Unknown: Linker Sequence
DIIKPDPPK

SEQ ID NO: 1852 - protein, 13 aa, Unknown
  Description of Unknown: Linker Sequence
KDQKEPKNKTFLR

SEQ ID NO: 1853 - protein, 7 aa, Unknown
  Description of Unknown: Linker Sequence
WDNQCQC

SEQ ID NO: 1854 - protein, 42 aa, Unknown
  Description of Unknown: Linker Sequence
SSATRSTTKQVTPQPEEQKERKTTEMQSPMQPVDQASLPGHC

SEQ ID NO: 1855 - protein, 5 aa, Unknown
  Description of Unknown: Linker Sequence
LNKPI

SEQ ID NO: 1856 - protein, 5 aa, Unknown
  Description of Unknown: Linker Sequence
NHQSN

SEQ ID NO: 1857 - protein, 5 aa, Unknown
  Description of Unknown: Linker Sequence
NSIDQ

SEQ ID NO: 1858 - protein, 7 aa, Unknown
  Description of Unknown: Linker Sequence
YLPNVTK

SEQ ID NO: 1859 - protein, 9 aa, Unknown
  Description of Unknown: Linker Sequence
LANLKNLGW

SEQ ID NO: 1860 - protein, 9 aa, Unknown
  Description of Unknown: Linker Sequence
LKDLKKLKS

SEQ ID NO: 1861 - protein, 10 aa, Unknown
  Description of Unknown: Linker Sequence
FLDENKVKDL

SEQ ID NO: 1862 - protein, 10 aa, Unknown
  Description of Unknown: Linker Sequence
NLKKKSVTDA

SEQ ID NO: 1863 - protein, 11 aa, Unknown
  Description of Unknown: Linker Sequence
FLNGNKLTDIK

SEQ ID NO: 1864 - protein, 11 aa, Unknown
  Description of Unknown: Linker Sequence
PNTVKNTDGSL

SEQ ID NO: 1865 - protein, 11 aa, Unknown
  Description of Unknown: Linker Sequence
SLEHNGISDIN

SEQ ID NO: 1866 - protein, 13 aa, Unknown
  Description of Unknown: Linker Sequence
IANNSDIKSVQGI

SEQ ID NO: 1867 - protein, 5 aa, Unknown
  Description of Unknown: Linker Sequence
FTTLT

SEQ ID NO: 1868 - protein, 5 aa, Unknown
  Description of Unknown: Linker Sequence
KAPEV

SEQ ID NO: 1869 - protein, 9 aa, Unknown
  Description of Unknown: Linker Sequence
VSDVAVDVV

SEQ ID NO: 1870 - protein, 6 aa, Unknown
  Description of Unknown: Linker Sequence
INTSYF

SEQ ID NO: 1871 - protein, 22 aa, Unknown
  Description of Unknown: Linker Sequence
SGIISLEDLPDYTRSDEPLNSI

SEQ ID NO: 1872 - protein, 4 aa, Unknown
  Description of Unknown: Linker Sequence
VNGQ

SEQ ID NO: 1873 - protein, 5 aa, Unknown
  Description of Unknown: Linker Sequence
FKNAT

SEQ ID NO: 1874 - protein, 5 aa, Unknown
  Description of Unknown: Linker Sequence
FYPNR

SEQ ID NO: 1875 - protein, 5 aa, Unknown
  Description of Unknown: Linker Sequence
MDNDV

SEQ ID NO: 1876 - protein, 6 aa, Unknown
  Description of Unknown: Linker Sequence
FPVPTL

SEQ ID NO: 1877 - protein, 6 aa, Unknown
  Description of Unknown: Linker Sequence
VNDQGQ

SEQ ID NO: 1878 - protein, 7 aa, Unknown
  Description of Unknown: Linker Sequence
SSFTPNV

SEQ ID NO: 1879 - protein, 7 aa, Unknown
  Description of Unknown: Linker Sequence
VKGTIAA

SEQ ID NO: 1880 - protein, 8 aa, Unknown
  Description of Unknown: Linker Sequence
SKKFPSYS

SEQ ID NO: 1881 - protein, 9 aa, Unknown
  Description of Unknown: Linker Sequence
ITYQTYSEV

SEQ ID NO: 1882 - protein, 10 aa, Unknown
  Description of Unknown: Linker Sequence
FATDKGFPKT

SEQ ID NO: 1883 - protein, 12 aa, Unknown
  Description of Unknown: Linker Sequence
TADPIPDAGRSS

SEQ ID NO: 1884 - protein, 4 aa, Unknown
  Description of Unknown: Linker Sequence
EKCF

SEQ ID NO: 1885 - protein, 4 aa, Unknown
  Description of Unknown: Linker Sequence
KNGK

SEQ ID NO: 1886 - protein, 5 aa, Unknown
  Description of Unknown: Linker Sequence
EKSHM

SEQ ID NO: 1887 - protein, 5 aa, Unknown
  Description of Unknown: Linker Sequence
NTNSD

SEQ ID NO: 1888 - protein, 6 aa, Unknown
  Description of Unknown: Linker Sequence
NAPEKH

SEQ ID NO: 1889 - protein, 7 aa, Unknown
  Description of Unknown: Linker Sequence
ACPVAAL

SEQ ID NO: 1890 - protein, 7 aa, Unknown
  Description of Unknown: Linker Sequence
DERSKSL

SEQ ID NO: 1891 - protein, 7 aa, Unknown
  Description of Unknown: Linker Sequence
KCLLCGR

SEQ ID NO: 1892 - protein, 7 aa, Unknown
  Description of Unknown: Linker Sequence
TETYAMK

SEQ ID NO: 1893 - protein, 9 aa, Unknown
  Description of Unknown: Linker Sequence
DTNCLLCGQ

SEQ ID NO: 1894 - protein, 10 aa, Unknown
  Description of Unknown: Linker Sequence
NGGGQPHVNP

SEQ ID NO: 1895 - protein, 14 aa, Unknown
  Description of Unknown: Linker Sequence
YKARASKPFLPKDK

SEQ ID NO: 1896 - protein, 18 aa, Unknown
  Description of Unknown: Linker Sequence
LDIHEFKCGPCNRRENCE

SEQ ID NO: 1897 - protein, 6 aa, Unknown
  Description of Unknown: Linker Sequence
VVGGEL

SEQ ID NO: 1898 - protein, 5 aa, Unknown
  Description of Unknown: Linker Sequence
HNGFF

SEQ ID NO: 1899 - protein, 11 aa, Unknown
  Description of Unknown: Linker Sequence
VKGKEGDEEEE

SEQ ID NO: 1900 - protein, 4 aa, Unknown
  Description of Unknown: Linker Sequence
KLIV

SEQ ID NO: 1901 - protein, 6 aa, Unknown
  Description of Unknown: Linker Sequence
TIGNRA

SEQ ID NO: 1902 - protein, 13 aa, Unknown
  Description of Unknown: Linker Sequence
VPPSKPTVNIPSS

SEQ ID NO: 1903 - protein, 5 aa, Unknown
  Description of Unknown: Linker Sequence
FFSIL

SEQ ID NO: 1904 - protein, 6 aa, Unknown
  Description of Unknown: Linker Sequence
TTGEWK

SEQ ID NO: 1905 - protein, 7 aa, Unknown
  Description of Unknown: Linker Sequence
MSTEEAE

SEQ ID NO: 1906 - protein, 8 aa, Unknown
  Description of Unknown: Linker Sequence
ASQVESDW

SEQ ID NO: 1907 - protein, 7 aa, Unknown
  Description of Unknown: Linker Sequence
KLHLSNC

SEQ ID NO: 1908 - protein, 4 aa, Unknown
  Description of Unknown: Linker Sequence
DANF

SEQ ID NO: 1909 - protein, 7 aa, Unknown
  Description of Unknown: Linker Sequence
VGLEKNA

SEQ ID NO: 1910 - protein, 8 aa, Unknown
  Description of Unknown: Linker Sequence
TNSTEETL

SEQ ID NO: 1911 - protein, 9 aa, Unknown
  Description of Unknown: Linker Sequence
KTWENVNAQ

SEQ ID NO: 1912 - protein, 9 aa, Unknown
  Description of Unknown: Linker Sequence
YLPTLYVSQ

SEQ ID NO: 1913 - protein, 11 aa, Unknown
  Description of Unknown: Linker Sequence
SHRYGFGKIDA

SEQ ID NO: 1914 - protein, 12 aa, Unknown
  Description of Unknown: Linker Sequence
GDWRDSAMGKKY

SEQ ID NO: 1915 - protein, 4 aa, Unknown
  Description of Unknown: Linker Sequence
KGTL

SEQ ID NO: 1916 - protein, 7 aa, Unknown
  Description of Unknown: Linker Sequence
KLNKDIV

SEQ ID NO: 1917 - protein, 8 aa, Unknown
  Description of Unknown: Linker Sequence
ETRKRALS

SEQ ID NO: 1918 - protein, 33 aa, Unknown
  Description of Unknown: Linker Sequence
VYPPDYNPEGKVTKRKHDNEGSGSKRPKVEYSE

SEQ ID NO: 1919 - protein, 8 aa, Unknown
  Description of Unknown: Linker Sequence
IERHSIHW

SEQ ID NO: 1920 - protein, 9 aa, Unknown
  Description of Unknown: Linker Sequence
DLTGTPLFV

SEQ ID NO: 1921 - protein, 10 aa, Unknown
  Description of Unknown: Linker Sequence
NGPASLPYDI

SEQ ID NO: 1922 - protein, 14 aa, Unknown
  Description of Unknown: Linker Sequence
VNGSDINVDWGKPI

SEQ ID NO: 1923 - protein, 44 aa, Unknown
  Description of Unknown: Linker Sequence
YAGAPGGLPTDEGTPPVDHQCLDTLDVRPVVPRSVPVNSFVKRP

SEQ ID NO: 1924 - protein, 6 aa, Unknown
  Description of Unknown: Linker Sequence
QFGRKG

SEQ ID NO: 1925 - protein, 9 aa, Unknown
  Description of Unknown: Linker Sequence
IASGAIGGL

SEQ ID NO: 1926 - protein, 4 aa, Unknown
  Description of Unknown: Linker Sequence
SGNP

SEQ ID NO: 1927 - protein, 6 aa, Unknown
  Description of Unknown: Linker Sequence
VTGISP

SEQ ID NO: 1928 - protein, 6 aa, Unknown
  Description of Unknown: Linker Sequence
IKRADA

SEQ ID NO: 1929 - protein, 7 aa, Unknown
  Description of Unknown: Linker Sequence
VQPKLTA

SEQ ID NO: 1930 - protein, 14 aa, Unknown
  Description of Unknown: Linker Sequence
TGVMKNDTNENLKK

SEQ ID NO: 1931 - protein, 24 aa, Unknown
  Description of Unknown: Linker Sequence
FLPRVGVGTSFGLPQTRRISLASP

SEQ ID NO: 1932 - protein, 4 aa, Unknown
  Description of Unknown: Linker Sequence
ASNM

SEQ ID NO: 1933 - protein, 6 aa, Unknown
  Description of Unknown: Linker Sequence
ESKPSV

SEQ ID NO: 1934 - protein, 7 aa, Unknown
  Description of Unknown: Linker Sequence
IKMLGSK

SEQ ID NO: 1935 - protein, 7 aa, Unknown
  Description of Unknown: Linker Sequence
LRREPNL

SEQ ID NO: 1936 - protein, 7 aa, Unknown
  Description of Unknown: Linker Sequence
LSRSSNP

SEQ ID NO: 1937 - protein, 8 aa, Unknown
  Description of Unknown: Linker Sequence
RLGCRYSK

SEQ ID NO: 1938 - protein, 4 aa, Unknown
  Description of Unknown: Linker Sequence
ETPA

SEQ ID NO: 1939 - protein, 8 aa, Unknown
  Description of Unknown: Linker Sequence
FANHTYVP

SEQ ID NO: 1940 - protein, 5 aa, Unknown
  Description of Unknown: Linker Sequence
LFEWL

SEQ ID NO: 1941 - protein, 14 aa, Unknown
  Description of Unknown: Linker Sequence
HELGGKNASGGYGG

SEQ ID NO: 1942 - protein, 5 aa, Unknown
  Description of Unknown: Linker Sequence
RGDVG

SEQ ID NO: 1943 - protein, 4 aa, Unknown
  Description of Unknown: Linker Sequence
DYTR

SEQ ID NO: 1944 - protein, 8 aa, Unknown
  Description of Unknown: Linker Sequence
QTQAVSQQ

SEQ ID NO: 1945 - protein, 8 aa, Unknown
  Description of Unknown: Linker Sequence
YTDHQMLV

SEQ ID NO: 1946 - protein, 4 aa, Unknown
  Description of Unknown: Linker Sequence
LNNR

SEQ ID NO: 1947 - protein, 12 aa, Unknown
  Description of Unknown: Linker Sequence
TCRKTNKLSPYD

SEQ ID NO: 1948 - protein, 5 aa, Unknown
  Description of Unknown: Linker Sequence
VVNNV

SEQ ID NO: 1949 - protein, 7 aa, Unknown
  Description of Unknown: Linker Sequence
VQARASS

SEQ ID NO: 1950 - protein, 8 aa, Unknown
  Description of Unknown: Linker Sequence
TYIPRKEV

SEQ ID NO: 1951 - protein, 10 aa, Unknown
  Description of Unknown: Linker Sequence
IQATIIRQNQ

SEQ ID NO: 1952 - protein, 4 aa, Unknown
  Description of Unknown: Linker Sequence
KGDD

SEQ ID NO: 1953 - protein, 4 aa, Unknown
  Description of Unknown: Linker Sequence
SDVV

SEQ ID NO: 1954 - protein, 6 aa, Unknown
  Description of Unknown: Linker Sequence
VAQSSY

SEQ ID NO: 1955 - protein, 8 aa, Unknown
  Description of Unknown: Linker Sequence
TSRDYDTQ

SEQ ID NO: 1956 - protein, 11 aa, Unknown
  Description of Unknown: Linker Sequence
YAPFLPKTWTS

SEQ ID NO: 1957 - protein, 5 aa, Unknown
  Description of Unknown: Linker Sequence
AGVNL

SEQ ID NO: 1958 - protein, 11 aa, Unknown
  Description of Unknown: Linker Sequence
TLLLKSPTTHP

SEQ ID NO: 1959 - protein, 5 aa, Unknown
  Description of Unknown: Linker Sequence
VESAM

SEQ ID NO: 1960 - protein, 6 aa, Unknown
  Description of Unknown: Linker Sequence
GPLWSN

SEQ ID NO: 1961 - protein, 9 aa, Unknown
  Description of Unknown: Linker Sequence
QVENTGIHE

SEQ ID NO: 1962 - protein, 8 aa, Unknown
  Description of Unknown: Linker Sequence
SCDNLPHN

SEQ ID NO: 1963 - protein, 16 aa, Unknown
  Description of Unknown: Linker Sequence
ICDRNHTWLPVSDDAC

SEQ ID NO: 1964 - protein, 4 aa, Unknown
  Description of Unknown: Linker Sequence
YYPA

SEQ ID NO: 1965 - protein, 5 aa, Unknown
  Description of Unknown: Linker Sequence
SGQPL

SEQ ID NO: 1966 - protein, 5 aa, Unknown
  Description of Unknown: Linker Sequence
VYSGK

SEQ ID NO: 1967 - protein, 7 aa, Unknown
  Description of Unknown: Linker Sequence
VNDQGKE

SEQ ID NO: 1968 - protein, 11 aa, Unknown
  Description of Unknown: Linker Sequence
FGNKYWLMLNE

SEQ ID NO: 1969 - protein, 19 aa, Unknown
  Description of Unknown: Linker Sequence
QSFAPVKGASAVPLVGRAS

SEQ ID NO: 1970 - protein, 4 aa, Unknown
  Description of Unknown: Linker Sequence
PVSE

SEQ ID NO: 1971 - protein, 5 aa, Unknown
  Description of Unknown: Linker Sequence
AGKLV

SEQ ID NO: 1972 - protein, 7 aa, Unknown
  Description of Unknown: Linker Sequence
LEKDGSN

SEQ ID NO: 1973 - protein, 14 aa, Unknown
  Description of Unknown: Linker Sequence
NNDPSWNPGPTWDP

SEQ ID NO: 1974 - protein, 4 aa, Unknown
  Description of Unknown: Linker Sequence
GVPF

SEQ ID NO: 1975 - protein, 4 aa, Unknown
  Description of Unknown: Linker Sequence
ICQS

SEQ ID NO: 1976 - protein, 6 aa, Unknown
  Description of Unknown: Linker Sequence
VNYEDP

SEQ ID NO: 1977 - protein, 8 aa, Unknown
  Description of Unknown: Linker Sequence
RARGENEP

SEQ ID NO: 1978 - protein, 6 aa, Unknown
  Description of Unknown: Linker Sequence
LAGTGP

SEQ ID NO: 1979 - protein, 10 aa, Unknown
  Description of Unknown: Linker Sequence
AAGGSVKGKK

SEQ ID NO: 1980 - protein, 8 aa, Unknown
  Description of Unknown: Linker Sequence
LMTPEYVA

SEQ ID NO: 1981 - protein, 17 aa, Unknown
  Description of Unknown: Linker Sequence
GFESVLEAVTALAFYVP

SEQ ID NO: 1982 - protein, 18 aa, Unknown
  Description of Unknown: Linker Sequence
HKLGAVDVPDLVYSEAGP

SEQ ID NO: 1983 - protein, 35 aa, Unknown
  Description of Unknown: Linker Sequence
QHPPKDSSGQRVAVSPTSQRLQLLEPFDKWDGKDL

SEQ ID NO: 1984 - protein, 41 aa, Unknown
  Description of Unknown: Linker Sequence
TLKFNPETDFLTGKDGKKFKLEAPDADELPRAEFDPGQDTY

SEQ ID NO: 1985 - protein, 4 aa, Unknown
  Description of Unknown: Linker Sequence
LVLE

SEQ ID NO: 1986 - protein, 4 aa, Unknown
  Description of Unknown: Linker Sequence
SESG

SEQ ID NO: 1987 - protein, 5 aa, Unknown
  Description of Unknown: Linker Sequence
EISGM

SEQ ID NO: 1988 - protein, 5 aa, Unknown
  Description of Unknown: Linker Sequence
FAARS

SEQ ID NO: 1989 - protein, 7 aa, Unknown
  Description of Unknown: Linker Sequence
QKSGKGL

SEQ ID NO: 1990 - protein, 11 aa, Unknown
  Description of Unknown: Linker Sequence
GEVFPQKKVSA

SEQ ID NO: 1991 - protein, 13 aa, Unknown
  Description of Unknown: Linker Sequence
KHPAVRKEPGPGL

SEQ ID NO: 1992 - protein, 14 aa, Unknown
  Description of Unknown: Linker Sequence
YPHWEGEIIRFETE

SEQ ID NO: 1993 - protein, 9 aa, Unknown
  Description of Unknown: Linker Sequence
EYPALGEVF

SEQ ID NO: 1994 - protein, 7 aa, Unknown
  Description of Unknown: Linker Sequence
QDDDCTP

SEQ ID NO: 1995 - protein, 4 aa, Unknown
  Description of Unknown: Linker Sequence
HNGK

SEQ ID NO: 1996 - protein, 5 aa, Unknown
  Description of Unknown: Linker Sequence
SSVSR

SEQ ID NO: 1997 - protein, 6 aa, Unknown
  Description of Unknown: Linker Sequence
AAHPVG

SEQ ID NO: 1998 - protein, 6 aa, Unknown
  Description of Unknown: Linker Sequence
ARFDVT

SEQ ID NO: 1999 - protein, 6 aa, Unknown
  Description of Unknown: Linker Sequence
EGRDMN

SEQ ID NO: 2000 - protein, 6 aa, Unknown
  Description of Unknown: Linker Sequence
KFLRTE

SEQ ID NO: 2001 - protein, 8 aa, Unknown
  Description of Unknown: Linker Sequence
LDLFYNTP

SEQ ID NO: 2002 - protein, 8 aa, Unknown
  Description of Unknown: Linker Sequence
RTAEQQEA

SEQ ID NO: 2003 - protein, 11 aa, Unknown
  Description of Unknown: Linker Sequence
YRAVPEGGQKE

SEQ ID NO: 2004 - protein, 8 aa, Unknown
  Description of Unknown: Linker Sequence
HDPRRFGR

SEQ ID NO: 2005 - protein, 10 aa, Unknown
  Description of Unknown: Linker Sequence
RRGDYREIPL

SEQ ID NO: 2006 - protein, 11 aa, Unknown
  Description of Unknown: Linker Sequence
RHAVYGREGLP

SEQ ID NO: 2007 - protein, 23 aa, Unknown
  Description of Unknown: Linker Sequence
ELGGSTLSDQSYRQPDGLPGGFQ

SEQ ID NO: 2008 - protein, 6 aa, Unknown
  Description of Unknown: Linker Sequence
ESGKTS

SEQ ID NO: 2009 - protein, 7 aa, Unknown
  Description of Unknown: Linker Sequence
FLDIHNI

SEQ ID NO: 2010 - protein, 7 aa, Unknown
  Description of Unknown: Linker Sequence
VYPNIEE

SEQ ID NO: 2011 - protein, 9 aa, Unknown
  Description of Unknown: Linker Sequence
RQGIPNESW

SEQ ID NO: 2012 - protein, 17 aa, Unknown
  Description of Unknown: Linker Sequence
TKINERYELCDTYPALL

SEQ ID NO: 2013 - protein, 4 aa, Unknown
  Description of Unknown: Linker Sequence
NGIV

SEQ ID NO: 2014 - protein, 5 aa, Unknown
  Description of Unknown: Linker Sequence
SRRVP

SEQ ID NO: 2015 - protein, 17 aa, Unknown
  Description of Unknown: Linker Sequence
LEKEKQFEKYSELKGTV

SEQ ID NO: 2016 - protein, 12 aa, Unknown
  Description of Unknown: Linker Sequence
KDSPKGVGRPTK

SEQ ID NO: 2017 - protein, 4 aa, Unknown
  Description of Unknown: Linker Sequence
ILIP

SEQ ID NO: 2018 - protein, 4 aa, Unknown
  Description of Unknown: Linker Sequence
LAPA

SEQ ID NO: 2019 - protein, 5 aa, Unknown
  Description of Unknown: Linker Sequence
CSGEY

SEQ ID NO: 2020 - protein, 5 aa, Unknown
  Description of Unknown: Linker Sequence
STPHP

SEQ ID NO: 2021 - protein, 5 aa, Unknown
  Description of Unknown: Linker Sequence
WGCDK

SEQ ID NO: 2022 - protein, 6 aa, Unknown
  Description of Unknown: Linker Sequence
YFAMDE

SEQ ID NO: 2023 - protein, 9 aa, Unknown
  Description of Unknown: Linker Sequence
RAETIDDIR

SEQ ID NO: 2024 - protein, 6 aa, Unknown
  Description of Unknown: Linker Sequence
NDDIQG

SEQ ID NO: 2025 - protein, 7 aa, Unknown
  Description of Unknown: Linker Sequence
YREKYCT

SEQ ID NO: 2026 - protein, 4 aa, Unknown
  Description of Unknown: Linker Sequence
DADL

SEQ ID NO: 2027 - protein, 4 aa, Unknown
  Description of Unknown: Linker Sequence
PNTA

SEQ ID NO: 2028 - protein, 5 aa, Unknown
  Description of Unknown: Linker Sequence
VAVGV

SEQ ID NO: 2029 - protein, 6 aa, Unknown
  Description of Unknown: Linker Sequence
VNIALA

SEQ ID NO: 2030 - protein, 17 aa, Unknown
  Description of Unknown: Linker Sequence
KNLEEPVKPFPGVQGSS

SEQ ID NO: 2031 - protein, 26 aa, Unknown
  Description of Unknown: Linker Sequence
LKGTLELHPNGLIKTDEYMRTSEPDV

SEQ ID NO: 2032 - protein, 6 aa, Unknown
  Description of Unknown: Linker Sequence
YYPQIA

SEQ ID NO: 2033 - protein, 4 aa, Unknown
  Description of Unknown: Linker Sequence
LGDA

SEQ ID NO: 2034 - protein, 7 aa, Unknown
  Description of Unknown: Linker Sequence
FKHSGGL

SEQ ID NO: 2035 - protein, 20 aa, Unknown
  Description of Unknown: Linker Sequence
FEAERKENCPACSQLPQNIQ

SEQ ID NO: 2036 - protein, 8 aa, Unknown
  Description of Unknown: Linker Sequence
YGLDTINK

SEQ ID NO: 2037 - protein, 9 aa, Unknown
  Description of Unknown: Linker Sequence
SMDNPDNEI

SEQ ID NO: 2038 - protein, 10 aa, Unknown
  Description of Unknown: Linker Sequence
QQGRYPGVSN

SEQ ID NO: 2039 - protein, 8 aa, Unknown
  Description of Unknown: Linker Sequence
TKLQNPDL

SEQ ID NO: 2040 - protein, 10 aa, Unknown
  Description of Unknown: Linker Sequence
GGRGYGSESG

SEQ ID NO: 2041 - protein, 12 aa, Unknown
  Description of Unknown: Linker Sequence
LQQHRPSPELTL

SEQ ID NO: 2042 - protein, 17 aa, Unknown
  Description of Unknown: Linker Sequence
LGGKWQPGRGPCVLQEY

SEQ ID NO: 2043 - protein, 5 aa, Unknown
  Description of Unknown: Linker Sequence
YQKLT

SEQ ID NO: 2044 - protein, 7 aa, Unknown
  Description of Unknown: Linker Sequence
FISNQTI

SEQ ID NO: 2045 - protein, 7 aa, Unknown
  Description of Unknown: Linker Sequence
SWEGNPI

SEQ ID NO: 2046 - protein, 8 aa, Unknown
  Description of Unknown: Linker Sequence
FREVVSPQ

SEQ ID NO: 2047 - protein, 9 aa, Unknown
  Description of Unknown: Linker Sequence
LADVPSSPY

SEQ ID NO: 2048 - protein, 4 aa, Unknown
  Description of Unknown: Linker Sequence
FVSA

SEQ ID NO: 2049 - protein, 4 aa, Unknown
  Description of Unknown: Linker Sequence
HKRS

SEQ ID NO: 2050 - protein, 5 aa, Unknown
  Description of Unknown: Linker Sequence
KAAPD

SEQ ID NO: 2051 - protein, 19 aa, Unknown
  Description of Unknown: Linker Sequence
PLDSPDETEDPEPNYAGEP

SEQ ID NO: 2052 - protein, 6 aa, Unknown
  Description of Unknown: Linker Sequence
EVGNEE

SEQ ID NO: 2053 - protein, 13 aa, Unknown
  Description of Unknown: Linker Sequence
ALPDEETGLELNE

SEQ ID NO: 2054 - protein, 4 aa, Unknown
  Description of Unknown: Linker Sequence
QVDA

SEQ ID NO: 2055 - protein, 5 aa, Unknown
  Description of Unknown: Linker Sequence
WRKDP

SEQ ID NO: 2056 - protein, 6 aa, Unknown
  Description of Unknown: Linker Sequence
PSHGII

SEQ ID NO: 2057 - protein, 7 aa, Unknown
  Description of Unknown: Linker Sequence
EGQGKAK

SEQ ID NO: 2058 - protein, 8 aa, Unknown
  Description of Unknown: Linker Sequence
KINLAIKT

SEQ ID NO: 2059 - protein, 8 aa, Unknown
  Description of Unknown: Linker Sequence
TEMYDTPT

SEQ ID NO: 2060 - protein, 6 aa, Unknown
  Description of Unknown: Linker Sequence
AHELPM

SEQ ID NO: 2061 - protein, 12 aa, Unknown
  Description of Unknown: Linker Sequence
EKPKGRDSKKVR

SEQ ID NO: 2062 - protein, 14 aa, Unknown
  Description of Unknown: Linker Sequence
IEGTSPEIVVNPVR

SEQ ID NO: 2063 - protein, 7 aa, Unknown
  Description of Unknown: Linker Sequence
QRTKVQI

SEQ ID NO: 2064 - protein, 26 aa, Unknown
  Description of Unknown: Linker Sequence
VDMGFDTSKLGSYQRVAEPVVPPQEM

SEQ ID NO: 2065 - protein, 5 aa, Unknown
  Description of Unknown: Linker Sequence
MNAHI

SEQ ID NO: 2066 - protein, 6 aa, Unknown
  Description of Unknown: Linker Sequence
ADDYQA

SEQ ID NO: 2067 - protein, 6 aa, Unknown
  Description of Unknown: Linker Sequence
YEGFTG

SEQ ID NO: 2068 - protein, 7 aa, Unknown
  Description of Unknown: Linker Sequence
QVDDPLK

SEQ ID NO: 2069 - protein, 11 aa, Unknown
  Description of Unknown: Linker Sequence
YKPKRFEYVTW

SEQ ID NO: 2070 - protein, 13 aa, Unknown
  Description of Unknown: Linker Sequence
ILPLWHHDDTYLF

SEQ ID NO: 2071 - protein, 22 aa, Unknown
  Description of Unknown: Linker Sequence
DMILPKKSVSKVKQTQLLTTEG

SEQ ID NO: 2072 - protein, 4 aa, Unknown
  Description of Unknown: Linker Sequence
IDNP

SEQ ID NO: 2073 - protein, 4 aa, Unknown
  Description of Unknown: Linker Sequence
GMDH

SEQ ID NO: 2074 - protein, 4 aa, Unknown
  Description of Unknown: Linker Sequence
IGDC

SEQ ID NO: 2075 - protein, 5 aa, Unknown
  Description of Unknown: Linker Sequence
EGVLH

SEQ ID NO: 2076 - protein, 5 aa, Unknown
  Description of Unknown: Linker Sequence
NQKEL

SEQ ID NO: 2077 - protein, 5 aa, Unknown
  Description of Unknown: Linker Sequence
QGNAL

SEQ ID NO: 2078 - protein, 5 aa, Unknown
  Description of Unknown: Linker Sequence
QSGYQ

SEQ ID NO: 2079 - protein, 6 aa, Unknown
  Description of Unknown: Linker Sequence
ARPDDE

SEQ ID NO: 2080 - protein, 6 aa, Unknown
  Description of Unknown: Linker Sequence
MGVSAI

SEQ ID NO: 2081 - protein, 6 aa, Unknown
  Description of Unknown: Linker Sequence
RNFQGY

SEQ ID NO: 2082 - protein, 7 aa, Unknown
  Description of Unknown: Linker Sequence
TTQGDTD

SEQ ID NO: 2083 - protein, 5 aa, Unknown
  Description of Unknown: Linker Sequence
IRDAN

SEQ ID NO: 2084 - protein, 7 aa, Unknown
  Description of Unknown: Linker Sequence
YARPSSA

SEQ ID NO: 2085 - protein, 4 aa, Unknown
  Description of Unknown: Linker Sequence
RGKF

SEQ ID NO: 2086 - protein, 4 aa, Unknown
  Description of Unknown: Linker Sequence
THAV

SEQ ID NO: 2087 - protein, 5 aa, Unknown
  Description of Unknown: Linker Sequence
ETPKI

SEQ ID NO: 2088 - protein, 5 aa, Unknown
  Description of Unknown: Linker Sequence
SDTAN

SEQ ID NO: 2089 - protein, 7 aa, Unknown
  Description of Unknown: Linker Sequence
TKQLAPT

SEQ ID NO: 2090 - protein, 10 aa, Unknown
  Description of Unknown: Linker Sequence
AGDYKNLGGE

SEQ ID NO: 2091 - protein, 19 aa, Unknown
  Description of Unknown: Linker Sequence
TYYTFNFSLEGAKMSLPGT

SEQ ID NO: 2092 - protein, 5 aa, Unknown
  Description of Unknown: Linker Sequence
YNKSS

SEQ ID NO: 2093 - protein, 8 aa, Unknown
  Description of Unknown: Linker Sequence
YGTPDYKY

SEQ ID NO: 2094 - protein, 11 aa, Unknown
  Description of Unknown: Linker Sequence
PYGKAHTLGLK

SEQ ID NO: 2095 - protein, 6 aa, Unknown
  Description of Unknown: Linker Sequence
DTEEKK

SEQ ID NO: 2096 - protein, 19 aa, Unknown
  Description of Unknown: Linker Sequence
DIPNRRRKVSKHKHANFYP

SEQ ID NO: 2097 - protein, 6 aa, Unknown
  Description of Unknown: Linker Sequence
PCSHVV

SEQ ID NO: 2098 - protein, 6 aa, Unknown
  Description of Unknown: Linker Sequence
ANENGT

SEQ ID NO: 2099 - protein, 6 aa, Unknown
  Description of Unknown: Linker Sequence
NRKNNI

SEQ ID NO: 2100 - protein, 8 aa, Unknown
  Description of Unknown: Linker Sequence
LAPEDYTG

SEQ ID NO: 2101 - protein, 4 aa, Unknown
  Description of Unknown: Linker Sequence
IGGK

SEQ ID NO: 2102 - protein, 4 aa, Unknown
  Description of Unknown: Linker Sequence
VGDD

SEQ ID NO: 2103 - protein, 6 aa, Unknown
  Description of Unknown: Linker Sequence
INTTKY

SEQ ID NO: 2104 - protein, 7 aa, Unknown
  Description of Unknown: Linker Sequence
AATVTGY

SEQ ID NO: 2105 - protein, 7 aa, Unknown
  Description of Unknown: Linker Sequence
GGADGKT

SEQ ID NO: 2106 - protein, 7 aa, Unknown
  Description of Unknown: Linker Sequence
QNKDGSI

SEQ ID NO: 2107 - protein, 7 aa, Unknown
  Description of Unknown: Linker Sequence
TDNNGKT

SEQ ID NO: 2108 - protein, 8 aa, Unknown
  Description of Unknown: Linker Sequence
AAGVTGTA

SEQ ID NO: 2109 - protein, 9 aa, Unknown
  Description of Unknown: Linker Sequence
QVGANDGET

SEQ ID NO: 2110 - protein, 11 aa, Unknown
  Description of Unknown: Linker Sequence
TADDGTSKTAL

SEQ ID NO: 2111 - protein, 21 aa, Unknown
  Description of Unknown: Linker Sequence
LKQINSQTLGLDTLNVQQKYK

SEQ ID NO: 2112 - protein, 23 aa, Unknown
  Description of Unknown: Linker Sequence
AEGHNFKAQPDLAEAAATTTENP

SEQ ID NO: 2113 - protein, 4 aa, Unknown
  Description of Unknown: Linker Sequence
AGAR

SEQ ID NO: 2114 - protein, 5 aa, Unknown
  Description of Unknown: Linker Sequence
AEALL

SEQ ID NO: 2115 - protein, 6 aa, Unknown
  Description of Unknown: Linker Sequence
AWPEEV

SEQ ID NO: 2116 - protein, 6 aa, Unknown
  Description of Unknown: Linker Sequence
NRGVEA

SEQ ID NO: 2117 - protein, 8 aa, Unknown
  Description of Unknown: Linker Sequence
EALPLPFA

SEQ ID NO: 2118 - protein, 8 aa, Unknown
  Description of Unknown: Linker Sequence
RGVDPLGQ

SEQ ID NO: 2119 - protein, 9 aa, Unknown
  Description of Unknown: Linker Sequence
LEVTPNRPD

SEQ ID NO: 2120 - protein, 9 aa, Unknown
  Description of Unknown: Linker Sequence
VEDPEGAPH

SEQ ID NO: 2121 - protein, 10 aa, Unknown
  Description of Unknown: Linker Sequence
AGSPKPPEAI

SEQ ID NO: 2122 - protein, 10 aa, Unknown
  Description of Unknown: Linker Sequence
FGLRVAPSPL

SEQ ID NO: 2123 - protein, 13 aa, Unknown
  Description of Unknown: Linker Sequence
TIPLALPAFFPAP

SEQ ID NO: 2124 - protein, 14 aa, Unknown
  Description of Unknown: Linker Sequence
LGYALVEPEAALKA

SEQ ID NO: 2125 - protein, 19 aa, Unknown
  Description of Unknown: Linker Sequence
LPLPDKPLAFQDPSRHPAA

SEQ ID NO: 2126 - protein, 5 aa, Unknown
  Description of Unknown: Linker Sequence
GLQSA

SEQ ID NO: 2127 - protein, 6 aa, Unknown
  Description of Unknown: Linker Sequence
HGELTR

SEQ ID NO: 2128 - protein, 7 aa, Unknown
  Description of Unknown: Linker Sequence
LKDKQLN

SEQ ID NO: 2129 - protein, 5 aa, Unknown
  Description of Unknown: Linker Sequence
FYPQY

SEQ ID NO: 2130 - protein, 7 aa, Unknown
  Description of Unknown: Linker Sequence
DFHYDEK

SEQ ID NO: 2131 - protein, 10 aa, Unknown
  Description of Unknown: Linker Sequence
DYLLDFSAVY

SEQ ID NO: 2132 - protein, 10 aa, Unknown
  Description of Unknown: Linker Sequence
PLDVTNRPRT

SEQ ID NO: 2133 - protein, 17 aa, Unknown
  Description of Unknown: Linker Sequence
NGEYSLKSAVKLPNVLS

SEQ ID NO: 2134 - protein, 6 aa, Unknown
  Description of Unknown: Linker Sequence
DRRAGL

SEQ ID NO: 2135 - protein, 7 aa, Unknown
  Description of Unknown: Linker Sequence
FLASMDE

SEQ ID NO: 2136 - protein, 8 aa, Unknown
  Description of Unknown: Linker Sequence
IMRETINV

SEQ ID NO: 2137 - protein, 11 aa, Unknown
  Description of Unknown: Linker Sequence
RFPNARTSYTM

SEQ ID NO: 2138 - protein, 6 aa, Unknown
  Description of Unknown: Linker Sequence
SDPAKV

SEQ ID NO: 2139 - protein, 11 aa, Unknown
  Description of Unknown: Linker Sequence
TSNGASCMPSM

SEQ ID NO: 2140 - protein, 12 aa, Unknown
  Description of Unknown: Linker Sequence
AGSAPAEPTGDV

SEQ ID NO: 2141 - protein, 7 aa, Unknown
  Description of Unknown: Linker Sequence
MRVKNDF

SEQ ID NO: 2142 - protein, 14 aa, Unknown
  Description of Unknown: Linker Sequence
YEGKDVHIKEDERY

SEQ ID NO: 2143 - protein, 15 aa, Unknown
  Description of Unknown: Linker Sequence
LGLKIIDLSAIQDEV

SEQ ID NO: 2144 - protein, 5 aa, Unknown
  Description of Unknown: Linker Sequence
LEPSR

SEQ ID NO: 2145 - protein, 6 aa, Unknown
  Description of Unknown: Linker Sequence
CSNVAA

SEQ ID NO: 2146 - protein, 8 aa, Unknown
  Description of Unknown: Linker Sequence
QKVTINPV

SEQ ID NO: 2147 - protein, 11 aa, Unknown
  Description of Unknown: Linker Sequence
ALPPGAAKQQL

SEQ ID NO: 2148 - protein, 11 aa, Unknown
  Description of Unknown: Linker Sequence
ALRRGTAGSVT

SEQ ID NO: 2149 - protein, 16 aa, Unknown
  Description of Unknown: Linker Sequence
ESFGATNTNARENTPF

SEQ ID NO: 2150 - protein, 4 aa, Unknown
  Description of Unknown: Linker Sequence
DCDY

SEQ ID NO: 2151 - protein, 4 aa, Unknown
  Description of Unknown: Linker Sequence
DWSD

SEQ ID NO: 2152 - protein, 4 aa, Unknown
  Description of Unknown: Linker Sequence
FAGQ

SEQ ID NO: 2153 - protein, 4 aa, Unknown
  Description of Unknown: Linker Sequence
HEGV

SEQ ID NO: 2154 - protein, 4 aa, Unknown
  Description of Unknown: Linker Sequence
RDGE

SEQ ID NO: 2155 - protein, 4 aa, Unknown
  Description of Unknown: Linker Sequence
SATR

SEQ ID NO: 2156 - protein, 4 aa, Unknown
  Description of Unknown: Linker Sequence
SIPA

SEQ ID NO: 2157 - protein, 4 aa, Unknown
  Description of Unknown: Linker Sequence
VYGQ

SEQ ID NO: 2158 - protein, 5 aa, Unknown
  Description of Unknown: Linker Sequence
ACGAT

SEQ ID NO: 2159 - protein, 5 aa, Unknown
  Description of Unknown: Linker Sequence
VYQAA

SEQ ID NO: 2160 - protein, 6 aa, Unknown
  Description of Unknown: Linker Sequence
EAGVDR

SEQ ID NO: 2161 - protein, 6 aa, Unknown
  Description of Unknown: Linker Sequence
SGGKTV

SEQ ID NO: 2162 - protein, 7 aa, Unknown
  Description of Unknown: Linker Sequence
VPLSEKV

SEQ ID NO: 2163 - protein, 8 aa, Unknown
  Description of Unknown: Linker Sequence
ANHPRGFA

SEQ ID NO: 2164 - protein, 9 aa, Unknown
  Description of Unknown: Linker Sequence
HDLQGERPY

SEQ ID NO: 2165 - protein, 10 aa, Unknown
  Description of Unknown: Linker Sequence
GCDGFHGISR

SEQ ID NO: 2166 - protein, 11 aa, Unknown
  Description of Unknown: Linker Sequence
ADTPPVSHELI

SEQ ID NO: 2167 - protein, 4 aa, Unknown
  Description of Unknown: Linker Sequence
GHRQ

SEQ ID NO: 2168 - protein, 4 aa, Unknown
  Description of Unknown: Linker Sequence
LTGA

SEQ ID NO: 2169 - protein, 6 aa, Unknown
  Description of Unknown: Linker Sequence
ALPSEL

SEQ ID NO: 2170 - protein, 6 aa, Unknown
  Description of Unknown: Linker Sequence
RAGGSI

SEQ ID NO: 2171 - protein, 6 aa, Unknown
  Description of Unknown: Linker Sequence
VSADNV

SEQ ID NO: 2172 - protein, 11 aa, Unknown
  Description of Unknown: Linker Sequence
HTQTDTSSPDP

SEQ ID NO: 2173 - protein, 12 aa, Unknown
  Description of Unknown: Linker Sequence
LKREKQDESCSL

SEQ ID NO: 2174 - protein, 13 aa, Unknown
  Description of Unknown: Linker Sequence
FNPLKTGVCQLDN

SEQ ID NO: 2175 - protein, 4 aa, Unknown
  Description of Unknown: Linker Sequence
ALGI

SEQ ID NO: 2176 - protein, 4 aa, Unknown
  Description of Unknown: Linker Sequence
KDGV

SEQ ID NO: 2177 - protein, 4 aa, Unknown
  Description of Unknown: Linker Sequence
NLRS

SEQ ID NO: 2178 - protein, 6 aa, Unknown
  Description of Unknown: Linker Sequence
EIPKPS

SEQ ID NO: 2179 - protein, 7 aa, Unknown
  Description of Unknown: Linker Sequence
EKMVEPQ

SEQ ID NO: 2180 - protein, 10 aa, Unknown
  Description of Unknown: Linker Sequence
KSKVYTRTPT

SEQ ID NO: 2181 - protein, 6 aa, Unknown
  Description of Unknown: Linker Sequence
ELVPKP

SEQ ID NO: 2182 - protein, 6 aa, Unknown
  Description of Unknown: Linker Sequence
FGFPGG

SEQ ID NO: 2183 - protein, 6 aa, Unknown
  Description of Unknown: Linker Sequence
LRNLDE

SEQ ID NO: 2184 - protein, 7 aa, Unknown
  Description of Unknown: Linker Sequence
FSNKKSW

SEQ ID NO: 2185 - protein, 7 aa, Unknown
  Description of Unknown: Linker Sequence
LFEKNDF

SEQ ID NO: 2186 - protein, 7 aa, Unknown
  Description of Unknown: Linker Sequence
LYPNACS

SEQ ID NO: 2187 - protein, 7 aa, Unknown
  Description of Unknown: Linker Sequence
RRAVYAN

SEQ ID NO: 2188 - protein, 7 aa, Unknown
  Description of Unknown: Linker Sequence
RSHRMPV

SEQ ID NO: 2189 - protein, 8 aa, Unknown
  Description of Unknown: Linker Sequence
EWNWPQPV

SEQ ID NO: 2190 - protein, 16 aa, Unknown
  Description of Unknown: Linker Sequence
ITPAYPSMCATHNITE

SEQ ID NO: 2191 - protein, 16 aa, Unknown
  Description of Unknown: Linker Sequence
RLDQPQVPLSLTLSDK

SEQ ID NO: 2192 - protein, 21 aa, Unknown
  Description of Unknown: Linker Sequence
ILKPIEDGPLQVRVWNPKIYA

SEQ ID NO: 2193 - protein, 16 aa, Unknown
  Description of Unknown: Linker Sequence
ISSSMTNSTAASRPPV

SEQ ID NO: 2194 - protein, 5 aa, Unknown
  Description of Unknown: Linker Sequence
ELVTV

SEQ ID NO: 2195 - protein, 11 aa, Unknown
  Description of Unknown: Linker Sequence
HDDLWQTLPDP

SEQ ID NO: 2196 - protein, 4 aa, Unknown
  Description of Unknown: Linker Sequence
QGTN

SEQ ID NO: 2197 - protein, 16 aa, Unknown
  Description of Unknown: Linker Sequence
NVYPELRVPDHQDIAF

SEQ ID NO: 2198 - protein, 6 aa, Unknown
  Description of Unknown: Linker Sequence
QLSVNQ

SEQ ID NO: 2199 - protein, 8 aa, Unknown
  Description of Unknown: Linker Sequence
DKAQFRNG

SEQ ID NO: 2200 - protein, 13 aa, Unknown
  Description of Unknown: Linker Sequence
ENPYRPVTFDYLM

SEQ ID NO: 2201 - protein, 27 aa, Unknown
  Description of Unknown: Linker Sequence
DYGNSPLHRFKKPGSKNFQNIFPPSAT

SEQ ID NO: 2202 - protein, 10 aa, Unknown
  Description of Unknown: Linker Sequence
FKPLPAQESE

SEQ ID NO: 2203 - protein, 7 aa, Unknown
  Description of Unknown: Linker Sequence
KAAGLEM

SEQ ID NO: 2204 - protein, 8 aa, Unknown
  Description of Unknown: Linker Sequence
EIPPQAII

SEQ ID NO: 2205 - protein, 27 aa, Unknown
  Description of Unknown: Linker Sequence
ESGEPSSLPRPATHWPFKTAFQHHYLV

SEQ ID NO: 2206 - protein, 8 aa, Unknown
  Description of Unknown: Linker Sequence
EVHYARPI

SEQ ID NO: 2207 - protein, 25 aa, Unknown
  Description of Unknown: Linker Sequence
WSRLKAKDWGSSSGSQGREDSVLSY

SEQ ID NO: 2208 - protein, 4 aa, Unknown
  Description of Unknown: Linker Sequence
LGTA

SEQ ID NO: 2209 - protein, 5 aa, Unknown
  Description of Unknown: Linker Sequence
LGRRF

SEQ ID NO: 2210 - protein, 6 aa, Unknown
  Description of Unknown: Linker Sequence
ANTDNT

SEQ ID NO: 2211 - protein, 6 aa, Unknown
  Description of Unknown: Linker Sequence
KRTIPA

SEQ ID NO: 2212 - protein, 7 aa, Unknown
  Description of Unknown: Linker Sequence
AIDDSNI

SEQ ID NO: 2213 - protein, 7 aa, Unknown
  Description of Unknown: Linker Sequence
PLTKTDV

SEQ ID NO: 2214 - protein, 8 aa, Unknown
  Description of Unknown: Linker Sequence
NYLVSDGI

SEQ ID NO: 2215 - protein, 9 aa, Unknown
  Description of Unknown: Linker Sequence
LLDDEGFNW

SEQ ID NO: 2216 - protein, 4 aa, Unknown
  Description of Unknown: Linker Sequence
TKAE

SEQ ID NO: 2217 - protein, 4 aa, Unknown
  Description of Unknown: Linker Sequence
TVAV

SEQ ID NO: 2218 - protein, 4 aa, Unknown
  Description of Unknown: Linker Sequence
YRTM

SEQ ID NO: 2219 - protein, 5 aa, Unknown
  Description of Unknown: Linker Sequence
ARTPL

SEQ ID NO: 2220 - protein, 5 aa, Unknown
  Description of Unknown: Linker Sequence
DRPDL

SEQ ID NO: 2221 - protein, 5 aa, Unknown
  Description of Unknown: Linker Sequence
TGTAK

SEQ ID NO: 2222 - protein, 5 aa, Unknown
  Description of Unknown: Linker Sequence
VAMQK

SEQ ID NO: 2223 - protein, 5 aa, Unknown
  Description of Unknown: Linker Sequence
YNMQV

SEQ ID NO: 2224 - protein, 6 aa, Unknown
  Description of Unknown: Linker Sequence
FRMYEK

SEQ ID NO: 2225 - protein, 6 aa, Unknown
  Description of Unknown: Linker Sequence
QAAKST

SEQ ID NO: 2226 - protein, 7 aa, Unknown
  Description of Unknown: Linker Sequence
YMTGQPV

SEQ ID NO: 2227 - protein, 8 aa, Unknown
  Description of Unknown: Linker Sequence
VVEDGQVV

SEQ ID NO: 2228 - protein, 10 aa, Unknown
  Description of Unknown: Linker Sequence
KEGLEIQNES

SEQ ID NO: 2229 - protein, 11 aa, Unknown
  Description of Unknown: Linker Sequence
AFGIDNLFDVK

SEQ ID NO: 2230 - protein, 11 aa, Unknown
  Description of Unknown: Linker Sequence
TIPTNRPVVRD

SEQ ID NO: 2231 - protein, 15 aa, Unknown
  Description of Unknown: Linker Sequence
VDSFTGRLMKGRRYS

SEQ ID NO: 2232 - protein, 24 aa, Unknown
  Description of Unknown: Linker Sequence
VRTLKAEKDYTYDIKTKAVQLTEE

SEQ ID NO: 2233 - protein, 12 aa, Unknown
  Description of Unknown: Linker Sequence
DLPPLEEGRYYY

SEQ ID NO: 2234 - protein, 18 aa, Unknown
  Description of Unknown: Linker Sequence
HGTALEHRRVVSPYGHRF

SEQ ID NO: 2235 - protein, 7 aa, Unknown
  Description of Unknown: Linker Sequence
AEANVEY

SEQ ID NO: 2236 - protein, 9 aa, Unknown
  Description of Unknown: Linker Sequence
IPLVTGPGV

SEQ ID NO: 2237 - protein, 4 aa, Unknown
  Description of Unknown: Linker Sequence
INDV

SEQ ID NO: 2238 - protein, 4 aa, Unknown
  Description of Unknown: Linker Sequence
KARL

SEQ ID NO: 2239 - protein, 5 aa, Unknown
  Description of Unknown: Linker Sequence
HPEHG

SEQ ID NO: 2240 - protein, 5 aa, Unknown
  Description of Unknown: Linker Sequence
YIGKP

SEQ ID NO: 2241 - protein, 7 aa, Unknown
  Description of Unknown: Linker Sequence
YGYRRLR

SEQ ID NO: 2242 - protein, 8 aa, Unknown
  Description of Unknown: Linker Sequence
EYLKRPLI

SEQ ID NO: 2243 - protein, 8 aa, Unknown
  Description of Unknown: Linker Sequence
FADLPRKY

SEQ ID NO: 2244 - protein, 8 aa, Unknown
  Description of Unknown: Linker Sequence
SGLQDVAH

SEQ ID NO: 2245 - protein, 13 aa, Unknown
  Description of Unknown: Linker Sequence
VGGGLSTNPMLAQ

SEQ ID NO: 2246 - protein, 15 aa, Unknown
  Description of Unknown: Linker Sequence
DDVGLQTTEACGDCP

SEQ ID NO: 2247 - protein, 16 aa, Unknown
  Description of Unknown: Linker Sequence
DGPAPEPVKHPIDHVG

SEQ ID NO: 2248 - protein, 16 aa, Unknown
  Description of Unknown: Linker Sequence
GSPLAGESLDEVLDPT

SEQ ID NO: 2249 - protein, 4 aa, Unknown
  Description of Unknown: Linker Sequence
EVRE

SEQ ID NO: 2250 - protein, 4 aa, Unknown
  Description of Unknown: Linker Sequence
HGEV

SEQ ID NO: 2251 - protein, 4 aa, Unknown
  Description of Unknown: Linker Sequence
KLPP

SEQ ID NO: 2252 - protein, 6 aa, Unknown
  Description of Unknown: Linker Sequence
FGREGN

SEQ ID NO: 2253 - protein, 6 aa, Unknown
  Description of Unknown: Linker Sequence
LGKGSS

SEQ ID NO: 2254 - protein, 6 aa, Unknown
  Description of Unknown: Linker Sequence
PFPKDV

SEQ ID NO: 2255 - protein, 6 aa, Unknown
  Description of Unknown: Linker Sequence
SEHFGE

SEQ ID NO: 2256 - protein, 6 aa, Unknown
  Description of Unknown: Linker Sequence
YTGVRR

SEQ ID NO: 2257 - protein, 7 aa, Unknown
  Description of Unknown: Linker Sequence
DTHTLDY

SEQ ID NO: 2258 - protein, 8 aa, Unknown
  Description of Unknown: Linker Sequence
ESDYEVGG

SEQ ID NO: 2259 - protein, 11 aa, Unknown
  Description of Unknown: Linker Sequence
GNLPLGAGLSS

SEQ ID NO: 2260 - protein, 13 aa, Unknown
  Description of Unknown: Linker Sequence
FSLNDLRKENSWI

SEQ ID NO: 2261 - protein, 9 aa, Unknown
  Description of Unknown: Linker Sequence
EHGLAPPDR

SEQ ID NO: 2262 - protein, 12 aa, Unknown
  Description of Unknown: Linker Sequence
AYPQTPLLPRDP

SEQ ID NO: 2263 - protein, 5 aa, Unknown
  Description of Unknown: Linker Sequence
QFATV

SEQ ID NO: 2264 - protein, 4 aa, Unknown
  Description of Unknown: Linker Sequence
LLTA

SEQ ID NO: 2265 - protein, 6 aa, Unknown
  Description of Unknown: Linker Sequence
ARHPLL

SEQ ID NO: 2266 - protein, 6 aa, Unknown
  Description of Unknown: Linker Sequence
LGGLEV

SEQ ID NO: 2267 - protein, 6 aa, Unknown
  Description of Unknown: Linker Sequence
WTEGWE

SEQ ID NO: 2268 - protein, 7 aa, Unknown
  Description of Unknown: Linker Sequence
YDEGLTS

SEQ ID NO: 2269 - protein, 8 aa, Unknown
  Description of Unknown: Linker Sequence
TLGLRSPV

SEQ ID NO: 2270 - protein, 14 aa, Unknown
  Description of Unknown: Linker Sequence
HLDLSAPKLRLREE

SEQ ID NO: 2271 - protein, 21 aa, Unknown
  Description of Unknown: Linker Sequence
YATEKEEPKPERTEVVAKLRR

SEQ ID NO: 2272 - protein, 6 aa, Unknown
  Description of Unknown: Linker Sequence
ELGVSL

SEQ ID NO: 2273 - protein, 6 aa, Unknown
  Description of Unknown: Linker Sequence
MSSKGT

SEQ ID NO: 2274 - protein, 7 aa, Unknown
  Description of Unknown: Linker Sequence
LKLGRAF

SEQ ID NO: 2275 - protein, 8 aa, Unknown
  Description of Unknown: Linker Sequence
GFNIEKFP

SEQ ID NO: 2276 - protein, 15 aa, Unknown
  Description of Unknown: Linker Sequence
TAPLPGYNTEFASGI

SEQ ID NO: 2277 - protein, 22 aa, Unknown
  Description of Unknown: Linker Sequence
CFRNEVGLPDSSKTEKVTSETV

SEQ ID NO: 2278 - protein, 4 aa, Unknown
  Description of Unknown: Linker Sequence
KSRT

SEQ ID NO: 2279 - protein, 5 aa, Unknown
  Description of Unknown: Linker Sequence
DRAGA

SEQ ID NO: 2280 - protein, 5 aa, Unknown
  Description of Unknown: Linker Sequence
FYVSA

SEQ ID NO: 2281 - protein, 5 aa, Unknown
  Description of Unknown: Linker Sequence
IATGG

SEQ ID NO: 2282 - protein, 5 aa, Unknown
  Description of Unknown: Linker Sequence
IGGGT

SEQ ID NO: 2283 - protein, 5 aa, Unknown
  Description of Unknown: Linker Sequence
LFRKI

SEQ ID NO: 2284 - protein, 5 aa, Unknown
  Description of Unknown: Linker Sequence
PRSLS

SEQ ID NO: 2285 - protein, 5 aa, Unknown
  Description of Unknown: Linker Sequence
TGKKV

SEQ ID NO: 2286 - protein, 6 aa, Unknown
  Description of Unknown: Linker Sequence
DVRGNM

SEQ ID NO: 2287 - protein, 6 aa, Unknown
  Description of Unknown: Linker Sequence
LNDGSQ

SEQ ID NO: 2288 - protein, 6 aa, Unknown
  Description of Unknown: Linker Sequence
NIENGG

SEQ ID NO: 2289 - protein, 6 aa, Unknown
  Description of Unknown: Linker Sequence
RDPGAR

SEQ ID NO: 2290 - protein, 6 aa, Unknown
  Description of Unknown: Linker Sequence
SREVKS

SEQ ID NO: 2291 - protein, 7 aa, Unknown
  Description of Unknown: Linker Sequence
RQWNGKE

SEQ ID NO: 2292 - protein, 7 aa, Unknown
  Description of Unknown: Linker Sequence
SIYFQPP

SEQ ID NO: 2293 - protein, 8 aa, Unknown
  Description of Unknown: Linker Sequence
VPQIRAPS

SEQ ID NO: 2294 - protein, 8 aa, Unknown
  Description of Unknown: Linker Sequence
WFSDDPNV

SEQ ID NO: 2295 - protein, 11 aa, Unknown
  Description of Unknown: Linker Sequence
SEDPELPYMRP

SEQ ID NO: 2296 - protein, 8 aa, Unknown
  Description of Unknown: Linker Sequence
AFDGPFDE

SEQ ID NO: 2297 - protein, 6 aa, Unknown
  Description of Unknown: Linker Sequence
HGDDRG

SEQ ID NO: 2298 - protein, 5 aa, Unknown
  Description of Unknown: Linker Sequence
LRPSP

SEQ ID NO: 2299 - protein, 4 aa, Unknown
  Description of Unknown: Linker Sequence
LNVA

SEQ ID NO: 2300 - protein, 6 aa, Unknown
  Description of Unknown: Linker Sequence
LSTSQK

SEQ ID NO: 2301 - protein, 21 aa, Unknown
  Description of Unknown: Linker Sequence
GAADIGLGYPNGNQGWGRVTL

SEQ ID NO: 2302 - protein, 4 aa, Unknown
  Description of Unknown: Linker Sequence
YIGI

SEQ ID NO: 2303 - protein, 7 aa, Unknown
  Description of Unknown: Linker Sequence
DGRVIRG

SEQ ID NO: 2304 - protein, 17 aa, Unknown
  Description of Unknown: Linker Sequence
TLSFDKSNDGETPEGIG

SEQ ID NO: 2305 - protein, 18 aa, Unknown
  Description of Unknown: Linker Sequence
EIAPLHAQGGGIDQLQGI

SEQ ID NO: 2306 - protein, 4 aa, Unknown
  Description of Unknown: Linker Sequence
ANNG

SEQ ID NO: 2307 - protein, 4 aa, Unknown
  Description of Unknown: Linker Sequence
ESNL

SEQ ID NO: 2308 - protein, 4 aa, Unknown
  Description of Unknown: Linker Sequence
KISA

SEQ ID NO: 2309 - protein, 4 aa, Unknown
  Description of Unknown: Linker Sequence
MDSA

SEQ ID NO: 2310 - protein, 4 aa, Unknown
  Description of Unknown: Linker Sequence
MMTP

SEQ ID NO: 2311 - protein, 4 aa, Unknown
  Description of Unknown: Linker Sequence
VGGI

SEQ ID NO: 2312 - protein, 5 aa, Unknown
  Description of Unknown: Linker Sequence
YTQRL

SEQ ID NO: 2313 - protein, 6 aa, Unknown
  Description of Unknown: Linker Sequence
AEKGKA

SEQ ID NO: 2314 - protein, 6 aa, Unknown
  Description of Unknown: Linker Sequence
MIRVPV

SEQ ID NO: 2315 - protein, 7 aa, Unknown
  Description of Unknown: Linker Sequence
SYTATED

SEQ ID NO: 2316 - protein, 8 aa, Unknown
  Description of Unknown: Linker Sequence
ETINPAHP

SEQ ID NO: 2317 - protein, 8 aa, Unknown
  Description of Unknown: Linker Sequence
SKFSGGNL

SEQ ID NO: 2318 - protein, 8 aa, Unknown
  Description of Unknown: Linker Sequence
TAYFVDAP

SEQ ID NO: 2319 - protein, 9 aa, Unknown
  Description of Unknown: Linker Sequence
ISPKEPHNK

SEQ ID NO: 2320 - protein, 9 aa, Unknown
  Description of Unknown: Linker Sequence
LSDKPGNPV

SEQ ID NO: 2321 - protein, 9 aa, Unknown
  Description of Unknown: Linker Sequence
RYPSITRDM

SEQ ID NO: 2322 - protein, 10 aa, Unknown
  Description of Unknown: Linker Sequence
MLSQVPYFSR

SEQ ID NO: 2323 - protein, 11 aa, Unknown
  Description of Unknown: Linker Sequence
APSRYFASEPK

SEQ ID NO: 2324 - protein, 14 aa, Unknown
  Description of Unknown: Linker Sequence
HTLDAVNIADRYDA

SEQ ID NO: 2325 - protein, 31 aa, Unknown
  Description of Unknown: Linker Sequence
ADIALSLPELNPYIPDDFSLIKSEKKYDHPE

SEQ ID NO: 2326 - protein, 7 aa, Unknown
  Description of Unknown: Linker Sequence
DVQPMQY

SEQ ID NO: 2327 - protein, 11 aa, Unknown
  Description of Unknown: Linker Sequence
HMSPSWTLLKL

SEQ ID NO: 2328 - protein, 8 aa, Unknown
  Description of Unknown: Linker Sequence
LEMVSKPM

SEQ ID NO: 2329 - protein, 51 aa, Unknown
  Description of Unknown: Linker Sequence
YGPKGKGKGMGAGTLSTDKGESLGIKYEEGQSHRPTNPNASRMAQKVGGSD

SEQ ID NO: 2330 - protein, 5 aa, Unknown
  Description of Unknown: Linker Sequence
VGQSL

SEQ ID NO: 2331 - protein, 6 aa, Unknown
  Description of Unknown: Linker Sequence
VSRSST

SEQ ID NO: 2332 - protein, 12 aa, Unknown
  Description of Unknown: Linker Sequence
ERNDVAPNKPDE

SEQ ID NO: 2333 - protein, 12 aa, Unknown
  Description of Unknown: Linker Sequence
TETAAAADPGLS

SEQ ID NO: 2334 - protein, 14 aa, Unknown
  Description of Unknown: Linker Sequence
VAESDRPELTSARR

SEQ ID NO: 2335 - protein, 4 aa, Unknown
  Description of Unknown: Linker Sequence
PFYP

SEQ ID NO: 2336 - protein, 6 aa, Unknown
  Description of Unknown: Linker Sequence
GVSEKP

SEQ ID NO: 2337 - protein, 9 aa, Unknown
  Description of Unknown: Linker Sequence
LGMGDVASL

SEQ ID NO: 2338 - protein, 15 aa, Unknown
  Description of Unknown: Linker Sequence
ALGGEARLPVLKDRN

SEQ ID NO: 2339 - protein, 17 aa, Unknown
  Description of Unknown: Linker Sequence
AAGLEAEAPKSAKELSL

SEQ ID NO: 2340 - protein, 4 aa, Unknown
  Description of Unknown: Linker Sequence
KGRF

SEQ ID NO: 2341 - protein, 5 aa, Unknown
  Description of Unknown: Linker Sequence
KAGSL

SEQ ID NO: 2342 - protein, 6 aa, Unknown
  Description of Unknown: Linker Sequence
NTGIFI

SEQ ID NO: 2343 - protein, 6 aa, Unknown
  Description of Unknown: Linker Sequence
QLVKSE

SEQ ID NO: 2344 - protein, 7 aa, Unknown
  Description of Unknown: Linker Sequence
KLKYVPH

SEQ ID NO: 2345 - protein, 7 aa, Unknown
  Description of Unknown: Linker Sequence
LGFDEVI

SEQ ID NO: 2346 - protein, 9 aa, Unknown
  Description of Unknown: Linker Sequence
MLATNLTDK

SEQ ID NO: 2347 - protein, 16 aa, Unknown
  Description of Unknown: Linker Sequence
LKDHILQFVIPNRGVT

SEQ ID NO: 2348 - protein, 17 aa, Unknown
  Description of Unknown: Linker Sequence
RAKGSTKFTRVPKRVYW

SEQ ID NO: 2349 - protein, 5 aa, Unknown
  Description of Unknown: Linker Sequence
FQKLM

SEQ ID NO: 2350 - protein, 6 aa, Unknown
  Description of Unknown: Linker Sequence
NAPTPQ

SEQ ID NO: 2351 - protein, 8 aa, Unknown
  Description of Unknown: Linker Sequence
EFKEGEDA

SEQ ID NO: 2352 - protein, 6 aa, Unknown
  Description of Unknown: Linker Sequence
AGTLLP

SEQ ID NO: 2353 - protein, 6 aa, Unknown
  Description of Unknown: Linker Sequence
LAPYKV

SEQ ID NO: 2354 - protein, 7 aa, Unknown
  Description of Unknown: Linker Sequence
ESIKDDK

SEQ ID NO: 2355 - protein, 7 aa, Unknown
  Description of Unknown: Linker Sequence
FHDKPEI

SEQ ID NO: 2356 - protein, 8 aa, Unknown
  Description of Unknown: Linker Sequence
ITTPKDDE

SEQ ID NO: 2357 - protein, 9 aa, Unknown
  Description of Unknown: Linker Sequence
HDITPSMTP

SEQ ID NO: 2358 - protein, 10 aa, Unknown
  Description of Unknown: Linker Sequence
AEATVAPVSP

SEQ ID NO: 2359 - protein, 11 aa, Unknown
  Description of Unknown: Linker Sequence
IDALADKYEPS

SEQ ID NO: 2360 - protein, 4 aa, Unknown
  Description of Unknown: Linker Sequence
FYGK

SEQ ID NO: 2361 - protein, 8 aa, Unknown
  Description of Unknown: Linker Sequence
ALSNTGEI

SEQ ID NO: 2362 - protein, 15 aa, Unknown
  Description of Unknown: Linker Sequence
TATPPGSVTVPHPNI

SEQ ID NO: 2363 - protein, 19 aa, Unknown
  Description of Unknown: Linker Sequence
RSPVFTDNSSPPAVPQSFQ

SEQ ID NO: 2364 - protein, 8 aa, Unknown
  Description of Unknown: Linker Sequence
IRNIDQDV

SEQ ID NO: 2365 - protein, 8 aa, Unknown
  Description of Unknown: Linker Sequence
REETNLMD

SEQ ID NO: 2366 - protein, 6 aa, Unknown
  Description of Unknown: Linker Sequence
HALPLV

SEQ ID NO: 2367 - protein, 6 aa, Unknown
  Description of Unknown: Linker Sequence
EGRSKK

SEQ ID NO: 2368 - protein, 27 aa, Unknown
  Description of Unknown: Linker Sequence
NKEKKAVSPLLLTTTNSSEGLSMGNYI

SEQ ID NO: 2369 - protein, 7 aa, Unknown
  Description of Unknown: Linker Sequence
DLASGQI

SEQ ID NO: 2370 - protein, 7 aa, Unknown
  Description of Unknown: Linker Sequence
TLANGAV

SEQ ID NO: 2371 - protein, 8 aa, Unknown
  Description of Unknown: Linker Sequence
DYDGYNQF

SEQ ID NO: 2372 - protein, 9 aa, Unknown
  Description of Unknown: Linker Sequence
DTGGAPGTV

SEQ ID NO: 2373 - protein, 9 aa, Unknown
  Description of Unknown: Linker Sequence
QTNGGQFPY

SEQ ID NO: 2374 - protein, 10 aa, Unknown
  Description of Unknown: Linker Sequence
TGIKGAFRTR

SEQ ID NO: 2375 - protein, 5 aa, Unknown
  Description of Unknown: Linker Sequence
SLPAR

SEQ ID NO: 2376 - protein, 4 aa, Unknown
  Description of Unknown: Linker Sequence
IYPD

SEQ ID NO: 2377 - protein, 4 aa, Unknown
  Description of Unknown: Linker Sequence
KCAV

SEQ ID NO: 2378 - protein, 4 aa, Unknown
  Description of Unknown: Linker Sequence
MAPK

SEQ ID NO: 2379 - protein, 4 aa, Unknown
  Description of Unknown: Linker Sequence
TESL

SEQ ID NO: 2380 - protein, 5 aa, Unknown
  Description of Unknown: Linker Sequence
ASADQ

SEQ ID NO: 2381 - protein, 10 aa, Unknown
  Description of Unknown: Linker Sequence
YTLRQPPPAT

SEQ ID NO: 2382 - protein, 11 aa, Unknown
  Description of Unknown: Linker Sequence
DQSDPNDPKSR

SEQ ID NO: 2383 - protein, 24 aa, Unknown
  Description of Unknown: Linker Sequence
SLHDMADEAGLPVQTEDGEATGTI

SEQ ID NO: 2384 - protein, 5 aa, Unknown
  Description of Unknown: Linker Sequence
DGIEE

SEQ ID NO: 2385 - protein, 6 aa, Unknown
  Description of Unknown: Linker Sequence
VEHLPK

SEQ ID NO: 2386 - protein, 4 aa, Unknown
  Description of Unknown: Linker Sequence
QAHS

SEQ ID NO: 2387 - protein, 7 aa, Unknown
  Description of Unknown: Linker Sequence
AKEAFVS

SEQ ID NO: 2388 - protein, 9 aa, Unknown
  Description of Unknown: Linker Sequence
QGILLHRSR

SEQ ID NO: 2389 - protein, 4 aa, Unknown
  Description of Unknown: Linker Sequence
ESEY

SEQ ID NO: 2390 - protein, 5 aa, Unknown
  Description of Unknown: Linker Sequence
DGPTP

SEQ ID NO: 2391 - protein, 8 aa, Unknown
  Description of Unknown: Linker Sequence
VGSEKVSK

SEQ ID NO: 2392 - protein, 4 aa, Unknown
  Description of Unknown: Linker Sequence
IGQS

SEQ ID NO: 2393 - protein, 15 aa, Unknown
  Description of Unknown: Linker Sequence
VSNINNTVSPSSASF

SEQ ID NO: 2394 - protein, 16 aa, Unknown
  Description of Unknown: Linker Sequence
ALPTNARPLLPPISNP

SEQ ID NO: 2395 - protein, 8 aa, Unknown
  Description of Unknown: Linker Sequence
VRERPVPR

SEQ ID NO: 2396 - protein, 9 aa, Unknown
  Description of Unknown: Linker Sequence
EQADGAVRG

SEQ ID NO: 2397 - protein, 13 aa, Unknown
  Description of Unknown: Linker Sequence
ARSGYRPDSGATP

SEQ ID NO: 2398 - protein, 8 aa, Unknown
  Description of Unknown: Linker Sequence
PDIDKLGY

SEQ ID NO: 2399 - protein, 5 aa, Unknown
  Description of Unknown: Linker Sequence
LGYSM

SEQ ID NO: 2400 - protein, 13 aa, Unknown
  Description of Unknown: Linker Sequence
SGVIKKFTAIIDP

SEQ ID NO: 2401 - protein, 6 aa, Unknown
  Description of Unknown: Linker Sequence
RTSRQL

SEQ ID NO: 2402 - protein, 4 aa, Unknown
  Description of Unknown: Linker Sequence
SGCK

SEQ ID NO: 2403 - protein, 5 aa, Unknown
  Description of Unknown: Linker Sequence
VSTGV

SEQ ID NO: 2404 - protein, 10 aa, Unknown
  Description of Unknown: Linker Sequence
QALDGDITDM

SEQ ID NO: 2405 - protein, 8 aa, Unknown
  Description of Unknown: Linker Sequence
HTAGSIPM

SEQ ID NO: 2406 - protein, 8 aa, Unknown
  Description of Unknown: Linker Sequence
WEGHVPHY

SEQ ID NO: 2407 - protein, 9 aa, Unknown
  Description of Unknown: Linker Sequence
VEGKREEAL

SEQ ID NO: 2408 - protein, 13 aa, Unknown
  Description of Unknown: Linker Sequence
PMQTFSKQREVDF

SEQ ID NO: 2409 - protein, 10 aa, Unknown
  Description of Unknown: Linker Sequence
VYFNERINVD

SEQ ID NO: 2410 - protein, 6 aa, Unknown
  Description of Unknown: Linker Sequence
SGGPAT

SEQ ID NO: 2411 - protein, 8 aa, Unknown
  Description of Unknown: Linker Sequence
YAATSTGR

SEQ ID NO: 2412 - protein, 9 aa, Unknown
  Description of Unknown: Linker Sequence
TGGTEAAGG

SEQ ID NO: 2413 - protein, 6 aa, Unknown
  Description of Unknown: Linker Sequence
FDPTEF

SEQ ID NO: 2414 - protein, 7 aa, Unknown
  Description of Unknown: Linker Sequence
VDLDFNR

SEQ ID NO: 2415 - protein, 10 aa, Unknown
  Description of Unknown: Linker Sequence
SNDAGFAMTS

SEQ ID NO: 2416 - protein, 11 aa, Unknown
  Description of Unknown: Linker Sequence
NGFDPATGDLS

SEQ ID NO: 2417 - protein, 8 aa, Unknown
  Description of Unknown: Linker Sequence
FSQPAPDR

SEQ ID NO: 2418 - protein, 5 aa, Unknown
  Description of Unknown: Linker Sequence
CQPNE

SEQ ID NO: 2419 - protein, 5 aa, Unknown
  Description of Unknown: Linker Sequence
KGVPC

SEQ ID NO: 2420 - protein, 5 aa, Unknown
  Description of Unknown: Linker Sequence
PFITE

SEQ ID NO: 2421 - protein, 6 aa, Unknown
  Description of Unknown: Linker Sequence
SIPTCE

SEQ ID NO: 2422 - protein, 6 aa, Unknown
  Description of Unknown: Linker Sequence
VEEHNI

SEQ ID NO: 2423 - protein, 7 aa, Unknown
  Description of Unknown: Linker Sequence
SNKEVIQ

SEQ ID NO: 2424 - protein, 7 aa, Unknown
  Description of Unknown: Linker Sequence
TAKGDTK

SEQ ID NO: 2425 - protein, 9 aa, Unknown
  Description of Unknown: Linker Sequence
GRWYPAFAD

SEQ ID NO: 2426 - protein, 16 aa, Unknown
  Description of Unknown: Linker Sequence
IFYDFLHVNVIPTVSF

SEQ ID NO: 2427 - protein, 5 aa, Unknown
  Description of Unknown: Linker Sequence
PGPAS

SEQ ID NO: 2428 - protein, 7 aa, Unknown
  Description of Unknown: Linker Sequence
KVSKKTG

SEQ ID NO: 2429 - protein, 8 aa, Unknown
  Description of Unknown: Linker Sequence
ACNIASMP

SEQ ID NO: 2430 - protein, 8 aa, Unknown
  Description of Unknown: Linker Sequence
FNDEASDE

SEQ ID NO: 2431 - protein, 18 aa, Unknown
  Description of Unknown: Linker Sequence
SLNAGELKKAAPADPSAP

SEQ ID NO: 2432 - protein, 10 aa, Unknown
  Description of Unknown: Linker Sequence
DKYYMASPDL

SEQ ID NO: 2433 - protein, 10 aa, Unknown
  Description of Unknown: Linker Sequence
NATNATQPIH

SEQ ID NO: 2434 - protein, 4 aa, Unknown
  Description of Unknown: Linker Sequence
EFPP

SEQ ID NO: 2435 - protein, 9 aa, Unknown
  Description of Unknown: Linker Sequence
ENELMYGVP

SEQ ID NO: 2436 - protein, 13 aa, Unknown
  Description of Unknown: Linker Sequence
QSKDFLIPIGKAK

SEQ ID NO: 2437 - protein, 4 aa, Unknown
  Description of Unknown: Linker Sequence
AGEV

SEQ ID NO: 2438 - protein, 4 aa, Unknown
  Description of Unknown: Linker Sequence
LHPT

SEQ ID NO: 2439 - protein, 4 aa, Unknown
  Description of Unknown: Linker Sequence
RIEA

SEQ ID NO: 2440 - protein, 4 aa, Unknown
  Description of Unknown: Linker Sequence
SPGA

SEQ ID NO: 2441 - protein, 4 aa, Unknown
  Description of Unknown: Linker Sequence
YFTA

SEQ ID NO: 2442 - protein, 6 aa, Unknown
  Description of Unknown: Linker Sequence
DGSTGK

SEQ ID NO: 2443 - protein, 6 aa, Unknown
  Description of Unknown: Linker Sequence
EKGERV

SEQ ID NO: 2444 - protein, 6 aa, Unknown
  Description of Unknown: Linker Sequence
KGDIET

SEQ ID NO: 2445 - protein, 7 aa, Unknown
  Description of Unknown: Linker Sequence
DEGMITE

SEQ ID NO: 2446 - protein, 7 aa, Unknown
  Description of Unknown: Linker Sequence
QEASVSG

SEQ ID NO: 2447 - protein, 4 aa, Unknown
  Description of Unknown: Linker Sequence
EAAN

SEQ ID NO: 2448 - protein, 4 aa, Unknown
  Description of Unknown: Linker Sequence
RYGL

SEQ ID NO: 2449 - protein, 5 aa, Unknown
  Description of Unknown: Linker Sequence
EVLDY

SEQ ID NO: 2450 - protein, 5 aa, Unknown
  Description of Unknown: Linker Sequence
RPFVS

SEQ ID NO: 2451 - protein, 5 aa, Unknown
  Description of Unknown: Linker Sequence
SLVNQ

SEQ ID NO: 2452 - protein, 5 aa, Unknown
  Description of Unknown: Linker Sequence
SMGSS

SEQ ID NO: 2453 - protein, 6 aa, Unknown
  Description of Unknown: Linker Sequence
SKEFSP

SEQ ID NO: 2454 - protein, 7 aa, Unknown
  Description of Unknown: Linker Sequence
AAKGEKI

SEQ ID NO: 2455 - protein, 7 aa, Unknown
  Description of Unknown: Linker Sequence
GAPDAER

SEQ ID NO: 2456 - protein, 7 aa, Unknown
  Description of Unknown: Linker Sequence
RGEAMPK

SEQ ID NO: 2457 - protein, 8 aa, Unknown
  Description of Unknown: Linker Sequence
SGAKKNHF

SEQ ID NO: 2458 - protein, 8 aa, Unknown
  Description of Unknown: Linker Sequence
TGRSYKLF

SEQ ID NO: 2459 - protein, 9 aa, Unknown
  Description of Unknown: Linker Sequence
AALPASAKV

SEQ ID NO: 2460 - protein, 9 aa, Unknown
  Description of Unknown: Linker Sequence
DGFRTSHEI

SEQ ID NO: 2461 - protein, 10 aa, Unknown
  Description of Unknown: Linker Sequence
KSMNPEHPHV

SEQ ID NO: 2462 - protein, 10 aa, Unknown
  Description of Unknown: Linker Sequence
RGTAQNPDIY

SEQ ID NO: 2463 - protein, 11 aa, Unknown
  Description of Unknown: Linker Sequence
WVPENCIQCNQ

SEQ ID NO: 2464 - protein, 12 aa, Unknown
  Description of Unknown: Linker Sequence
DRTKEPGAPGDP

SEQ ID NO: 2465 - protein, 28 aa, Unknown
  Description of Unknown: Linker Sequence
TVGIEDDVTGTSLPVDNAFADTTPKGTI

SEQ ID NO: 2466 - protein, 4 aa, Unknown
  Description of Unknown: Linker Sequence
AGED

SEQ ID NO: 2467 - protein, 4 aa, Unknown
  Description of Unknown: Linker Sequence
DADS

SEQ ID NO: 2468 - protein, 4 aa, Unknown
  Description of Unknown: Linker Sequence
DGTV

SEQ ID NO: 2469 - protein, 4 aa, Unknown
  Description of Unknown: Linker Sequence
QDGR

SEQ ID NO: 2470 - protein, 5 aa, Unknown
  Description of Unknown: Linker Sequence
LGAGE

SEQ ID NO: 2471 - protein, 5 aa, Unknown
  Description of Unknown: Linker Sequence
QPGRG

SEQ ID NO: 2472 - protein, 6 aa, Unknown
  Description of Unknown: Linker Sequence
DFADGS

SEQ ID NO: 2473 - protein, 6 aa, Unknown
  Description of Unknown: Linker Sequence
YDRPDR

SEQ ID NO: 2474 - protein, 7 aa, Unknown
  Description of Unknown: Linker Sequence
KADAAPQ

SEQ ID NO: 2475 - protein, 15 aa, Unknown
  Description of Unknown: Linker Sequence
PLGEAPDAYADDASG

SEQ ID NO: 2476 - protein, 4 aa, Unknown
  Description of Unknown: Linker Sequence
PCFP

SEQ ID NO: 2477 - protein, 7 aa, Unknown
  Description of Unknown: Linker Sequence
DLESPVK

SEQ ID NO: 2478 - protein, 7 aa, Unknown
  Description of Unknown: Linker Sequence
FLRIQNV

SEQ ID NO: 2479 - protein, 10 aa, Unknown
  Description of Unknown: Linker Sequence
LGHPCTRTPH

SEQ ID NO: 2480 - protein, 6 aa, Unknown
  Description of Unknown: Linker Sequence
HFPKTF

SEQ ID NO: 2481 - protein, 7 aa, Unknown
  Description of Unknown: Linker Sequence
RKLLGVK

SEQ ID NO: 2482 - protein, 7 aa, Unknown
  Description of Unknown: Linker Sequence
SATPIPR

SEQ ID NO: 2483 - protein, 8 aa, Unknown
  Description of Unknown: Linker Sequence
FYGDLDVT

SEQ ID NO: 2484 - protein, 8 aa, Unknown
  Description of Unknown: Linker Sequence
SLPFKLTN

SEQ ID NO: 2485 - protein, 9 aa, Unknown
  Description of Unknown: Linker Sequence
CSLKETLPE

SEQ ID NO: 2486 - protein, 9 aa, Unknown
  Description of Unknown: Linker Sequence
ISEKPMNRL

SEQ ID NO: 2487 - protein, 9 aa, Unknown
  Description of Unknown: Linker Sequence
TMLVPMDRV

SEQ ID NO: 2488 - protein, 10 aa, Unknown
  Description of Unknown: Linker Sequence
IYRLTSGISQ

SEQ ID NO: 2489 - protein, 11 aa, Unknown
  Description of Unknown: Linker Sequence
HGGIPKKIEGK

SEQ ID NO: 2490 - protein, 12 aa, Unknown
  Description of Unknown: Linker Sequence
IDEMPPGRKEVQ

SEQ ID NO: 2491 - protein, 12 aa, Unknown
  Description of Unknown: Linker Sequence
TPKEGEYVRRIL

SEQ ID NO: 2492 - protein, 9 aa, Unknown
  Description of Unknown: Linker Sequence
KSDYTQNNI

SEQ ID NO: 2493 - protein, 15 aa, Unknown
  Description of Unknown: Linker Sequence
EGMGPVLAPVTPVPV

SEQ ID NO: 2494 - protein, 7 aa, Unknown
  Description of Unknown: Linker Sequence
MLNQNWH

SEQ ID NO: 2495 - protein, 10 aa, Unknown
  Description of Unknown: Linker Sequence
NMTNATDASP

SEQ ID NO: 2496 - protein, 14 aa, Unknown
  Description of Unknown: Linker Sequence
LLYDERTTNLTLDE

SEQ ID NO: 2497 - protein, 6 aa, Unknown
  Description of Unknown: Linker Sequence
EAGYPG

SEQ ID NO: 2498 - protein, 7 aa, Unknown
  Description of Unknown: Linker Sequence
LFDSLSP

SEQ ID NO: 2499 - protein, 7 aa, Unknown
  Description of Unknown: Linker Sequence
TREGKST

SEQ ID NO: 2500 - protein, 5 aa, Unknown
  Description of Unknown: Linker Sequence
AEGDM

SEQ ID NO: 2501 - protein, 6 aa, Unknown
  Description of Unknown: Linker Sequence
AALDKK

SEQ ID NO: 2502 - protein, 6 aa, Unknown
  Description of Unknown: Linker Sequence
ENEGLE

SEQ ID NO: 2503 - protein, 7 aa, Unknown
  Description of Unknown: Linker Sequence
RFRPLRD

SEQ ID NO: 2504 - protein, 7 aa, Unknown
  Description of Unknown: Linker Sequence
VASRARP

SEQ ID NO: 2505 - protein, 4 aa, Unknown
  Description of Unknown: Linker Sequence
TKNI

SEQ ID NO: 2506 - protein, 6 aa, Unknown
  Description of Unknown: Linker Sequence
VSAGST

SEQ ID NO: 2507 - protein, 9 aa, Unknown
  Description of Unknown: Linker Sequence
SGSVKTGTT

SEQ ID NO: 2508 - protein, 10 aa, Unknown
  Description of Unknown: Linker Sequence
DLDIKGYVAA

SEQ ID NO: 2509 - protein, 13 aa, Unknown
  Description of Unknown: Linker Sequence
SRSGTPSTSIDTS

SEQ ID NO: 2510 - protein, 9 aa, Unknown
  Description of Unknown: Linker Sequence
CDGDEYKPV

SEQ ID NO: 2511 - protein, 14 aa, Unknown
  Description of Unknown: Linker Sequence
DGPCEPDEDEDVCQ

SEQ ID NO: 2512 - protein, 14 aa, Unknown
  Description of Unknown: Linker Sequence
RAVLSSTRMGGHFV

SEQ ID NO: 2513 - protein, 4 aa, Unknown
  Description of Unknown: Linker Sequence
QLRT

SEQ ID NO: 2514 - protein, 5 aa, Unknown
  Description of Unknown: Linker Sequence
DITNA

SEQ ID NO: 2515 - protein, 6 aa, Unknown
  Description of Unknown: Linker Sequence
QEVVAP

SEQ ID NO: 2516 - protein, 4 aa, Unknown
  Description of Unknown: Linker Sequence
ILGE

SEQ ID NO: 2517 - protein, 5 aa, Unknown
  Description of Unknown: Linker Sequence
SQGGK

SEQ ID NO: 2518 - protein, 6 aa, Unknown
  Description of Unknown: Linker Sequence
IARPPA

SEQ ID NO: 2519 - protein, 7 aa, Unknown
  Description of Unknown: Linker Sequence
PTFAVER

SEQ ID NO: 2520 - protein, 12 aa, Unknown
  Description of Unknown: Linker Sequence
EGTYGDRPHRPY

SEQ ID NO: 2521 - protein, 24 aa, Unknown
  Description of Unknown: Linker Sequence
YSGDLGNREKDVLPDPSLPPLADL

SEQ ID NO: 2522 - protein, 4 aa, Unknown
  Description of Unknown: Linker Sequence
DYTE

SEQ ID NO: 2523 - protein, 4 aa, Unknown
  Description of Unknown: Linker Sequence
TFSY

SEQ ID NO: 2524 - protein, 6 aa, Unknown
  Description of Unknown: Linker Sequence
DTFIDH

SEQ ID NO: 2525 - protein, 8 aa, Unknown
  Description of Unknown: Linker Sequence
EMGKYDNH

SEQ ID NO: 2526 - protein, 9 aa, Unknown
  Description of Unknown: Linker Sequence
YGQFEPPAL

SEQ ID NO: 2527 - protein, 16 aa, Unknown
  Description of Unknown: Linker Sequence
KYLVQNRVTGEIYESA

SEQ ID NO: 2528 - protein, 13 aa, Unknown
  Description of Unknown: Linker Sequence
DLSVFPELEEGDY

SEQ ID NO: 2529 - protein, 9 aa, Unknown
  Description of Unknown: Linker Sequence
DYGFIEPNE

SEQ ID NO: 2530 - protein, 5 aa, Unknown
  Description of Unknown: Linker Sequence
PAPAP

SEQ ID NO: 2531 - protein, 10 aa, Unknown
  Description of Unknown: Linker Sequence
APAPAPAPAP

SEQ ID NO: 2532 - protein, 12 aa, Unknown
  Description of Unknown: Linker Sequence
APAPAPAPAPAP

SEQ ID NO: 2533 - protein, 14 aa, Unknown
  Description of Unknown: Linker Sequence
APAPAPAPAPAPAP

SEQ ID NO: 2534 - protein, 16 aa, Unknown
  Description of Unknown: Linker Sequence
APAPAPAPAPAPAPAP

SEQ ID NO: 2535 - protein, 18 aa, Unknown
  Description of Unknown: Linker Sequence
APAPAPAPAPAPAPAPAP

SEQ ID NO: 2536 - protein, 20 aa, Unknown
  Description of Unknown: Linker Sequence
APAPAPAPAPAPAPAPAPAP

SEQ ID NO: 2537 - protein, 22 aa, Unknown
  Description of Unknown: Linker Sequence
APAPAPAPAPAPAPAPAPAPAP

SEQ ID NO: 2538 - protein, 24 aa, Unknown
  Description of Unknown: Linker Sequence
APAPAPAPAPAPAPAPAPAPAPAP

SEQ ID NO: 2539 - protein, 26 aa, Unknown
  Description of Unknown: Linker Sequence
APAPAPAPAPAPAPAPAPAPAPAPAP

SEQ ID NO: 2540 - protein, 28 aa, Unknown
  Description of Unknown: Linker Sequence
APAPAPAPAPAPAPAPAPAPAPAPAPAP

SEQ ID NO: 2541 - protein, 30 aa, Unknown
  Description of Unknown: Linker Sequence
APAPAPAPAPAPAPAPAPAPAPAPAPAPAP

SEQ ID NO: 2542 - protein, 32 aa, Unknown
  Description of Unknown: Linker Sequence
APAPAPAPAPAPAPAPAPAPAPAPAPAPAPAP

SEQ ID NO: 2543 - protein, 33 aa, Unknown
  Description of Unknown: Linker Sequence
EPEPEPEPIPEPPKEAPVVIEKPKPKPKPKPKP

SEQ ID NO: 2544 - protein, 34 aa, Unknown
  Description of Unknown: Linker Sequence
APAPAPAPAPAPAPAPAPAPAPAPAPAPAPAPAP

SEQ ID NO: 2545 - protein, 5 aa, Unknown
  Description of Unknown: Linker Sequence
EAAAK

SEQ ID NO: 2546 - protein, 10 aa, Unknown
  Description of Unknown: Linker Sequence
EAAAKEAAAK

SEQ ID NO: 2547 - protein, 12 aa, Unknown
  Description of Unknown: Linker Sequence
AEAAAKEAAAKA

SEQ ID NO: 2548 - protein, 15 aa, Unknown
  Description of Unknown: Linker Sequence
EAAAKEAAAKEAAAK

SEQ ID NO: 2549 - protein, 17 aa, Unknown
  Description of Unknown: Linker Sequence
AEAAAKEAAAKEAAAKA

SEQ ID NO: 2550 - protein, 22 aa, Unknown
  Description of Unknown: Linker Sequence
AEAAAKEAAAKEAAAKEAAAKA

SEQ ID NO: 2551 - protein, 27 aa, Unknown
  Description of Unknown: Linker Sequence
AEAAAKEAAAKEAAAKEAAAKEAAAKA

SEQ ID NO: 2552 - protein, 46 aa, Unknown
  Description of Unknown: Linker Sequence
AEAAAKEAAAKEAAAKEAAAKALEAEAAAKEAAAKEAAAKEAAAKA

SEQ ID NO: 2553 - protein, 6 aa, Unknown
  Description of Unknown: Linker Sequence
KSGEDI

SEQ ID NO: 2554 - protein, 29 aa, Unknown
  Description of Unknown: Linker Sequence
INQGEDSVPAKKFKAAPAEISDGEDRSKC

SEQ ID NO: 2555 - protein, 5 aa, Unknown
  Description of Unknown: Linker Sequence
RSPEW

SEQ ID NO: 2556 - protein, 19 aa, Unknown
  Description of Unknown: Linker Sequence
SAFGIRPPLRLGEFTMPEH

SEQ ID NO: 2557 - protein, 12 aa, Unknown
  Description of Unknown: Linker Sequence
LNTGASDNFTRW

SEQ ID NO: 2558 - protein, 12 aa, Unknown
  Description of Unknown: Linker Sequence
AEKGEDIEIKKV

SEQ ID NO: 2559 - protein, 15 aa, Unknown
  Description of Unknown: Linker Sequence
VDRADPLEQGAGDQG

SEQ ID NO: 2560 - protein, 4 aa, Unknown
  Description of Unknown: Linker Sequence
DGDF

SEQ ID NO: 2561 - protein, 4 aa, Unknown
  Description of Unknown: Linker Sequence
KNDK

SEQ ID NO: 2562 - protein, 4 aa, Unknown
  Description of Unknown: Linker Sequence
PIRS

SEQ ID NO: 2563 - protein, 4 aa, Unknown
  Description of Unknown: Linker Sequence
PMTG

SEQ ID NO: 2564 - protein, 4 aa, Unknown
  Description of Unknown: Linker Sequence
RACC

SEQ ID NO: 2565 - protein, 4 aa, Unknown
  Description of Unknown: Linker Sequence
VGTT

SEQ ID NO: 2566 - protein, 5 aa, Unknown
  Description of Unknown: Linker Sequence
DAGIR

SEQ ID NO: 2567 - protein, 5 aa, Unknown
  Description of Unknown: Linker Sequence
DDLPL

SEQ ID NO: 2568 - protein, 5 aa, Unknown
  Description of Unknown: Linker Sequence
GCTSV

SEQ ID NO: 2569 - protein, 5 aa, Unknown
  Description of Unknown: Linker Sequence
ITAFV

SEQ ID NO: 2570 - protein, 5 aa, Unknown
  Description of Unknown: Linker Sequence
TASEM

SEQ ID NO: 2571 - protein, 5 aa, Unknown
  Description of Unknown: Linker Sequence
TGDNK

SEQ ID NO: 2572 - protein, 5 aa, Unknown
  Description of Unknown: Linker Sequence
YETDL

SEQ ID NO: 2573 - protein, 6 aa, Unknown
  Description of Unknown: Linker Sequence
LADDNF

SEQ ID NO: 2574 - protein, 6 aa, Unknown
  Description of Unknown: Linker Sequence
MGSGTA

SEQ ID NO: 2575 - protein, 7 aa, Unknown
  Description of Unknown: Linker Sequence
ARVEPSH

SEQ ID NO: 2576 - protein, 7 aa, Unknown
  Description of Unknown: Linker Sequence
EMVLDDS

SEQ ID NO: 2577 - protein, 7 aa, Unknown
  Description of Unknown: Linker Sequence
RDTPPKR

SEQ ID NO: 2578 - protein, 7 aa, Unknown
  Description of Unknown: Linker Sequence
TGRDTLR

SEQ ID NO: 2579 - protein, 8 aa, Unknown
  Description of Unknown: Linker Sequence
LDPPRKEV

SEQ ID NO: 2580 - protein, 9 aa, Unknown
  Description of Unknown: Linker Sequence
LAWFEEGEE

SEQ ID NO: 2581 - protein, 10 aa, Unknown
  Description of Unknown: Linker Sequence
ALGLPEALIP

SEQ ID NO: 2582 - protein, 12 aa, Unknown
  Description of Unknown: Linker Sequence
DKTGTLTTNQMS

SEQ ID NO: 2583 - protein, 12 aa, Unknown
  Description of Unknown: Linker Sequence
ITGSTYAPEGEV

SEQ ID NO: 2584 - protein, 14 aa, Unknown
  Description of Unknown: Linker Sequence
IGIFGENEEVADRA

SEQ ID NO: 2585 - protein, 6 aa, Unknown
  Description of Unknown: Linker Sequence
YLRQDL

SEQ ID NO: 2586 - protein, 8 aa, Unknown
  Description of Unknown: Linker Sequence
ESQSLSIQ

SEQ ID NO: 2587 - protein, 6 aa, Unknown
  Description of Unknown: Linker Sequence
SGKQSY

SEQ ID NO: 2588 - protein, 14 aa, Unknown
  Description of Unknown: Linker Sequence
FRARGKAVSTVFDQ

SEQ ID NO: 2589 - protein, 6 aa, Unknown
  Description of Unknown: Linker Sequence
DANSEM

SEQ ID NO: 2590 - protein, 7 aa, Unknown
  Description of Unknown: Linker Sequence
DITAQKE

SEQ ID NO: 2591 - protein, 8 aa, Unknown
  Description of Unknown: Linker Sequence
TVESTGKV

SEQ ID NO: 2592 - protein, 5 aa, Unknown
  Description of Unknown: Linker Sequence
AQDRK

SEQ ID NO: 2593 - protein, 4 aa, Unknown
  Description of Unknown: Linker Sequence
FYGK

SEQ ID NO: 2594 - protein, 8 aa, Unknown
  Description of Unknown: Linker Sequence
ALSSTGEI

SEQ ID NO: 2595 - protein, 15 aa, Unknown
  Description of Unknown: Linker Sequence
TATPPGSVTVPHPNI

SEQ ID NO: 2596 - protein, 5 aa, Unknown
  Description of Unknown: Linker Sequence
SSSSG

SEQ ID NO: 2597 - protein, 10 aa, Unknown
  Description of Unknown: Linker Sequence
SSSSGSSSSG

SEQ ID NO: 2598 - protein, 13 aa, Unknown
  Description of Unknown: Linker Sequence
SGSSSSGSSSSGS

SEQ ID NO: 2599 - protein, 15 aa, Unknown
  Description of Unknown: Linker Sequence
SSSSGSSSSGSSSSG

SEQ ID NO: 2600 - protein, 19 aa, Unknown
  Description of Unknown: Linker Sequence
SVTVSSSGSSSSGSSSSGS

SEQ ID NO: 2601 - protein, 20 aa, Unknown
  Description of Unknown: Linker Sequence
SSSSGSSSSGSSSSGSSSSG

SEQ ID NO: 2602 - protein, 25 aa, Unknown
  Description of Unknown: Linker Sequence
SSSSGSSSSGSSSSGSSSSGSSSSG

SEQ ID NO: 2603 - protein, 17 aa, Unknown
  Description of Unknown: Linker Sequence
LLQVPLPPWPGAPVGGE

SEQ ID NO: 2604 - protein, 6 aa, Unknown
  Description of Unknown: Linker Sequence
FRGPDR

SEQ ID NO: 2605 - protein, 4 aa, Unknown
  Description of Unknown: Linker Sequence
EGGK

SEQ ID NO: 2606 - protein, 6 aa, Unknown
  Description of Unknown: Linker Sequence
INDKYE

SEQ ID NO: 2607 - protein, 6 aa, Unknown
  Description of Unknown: Linker Sequence
NETTNK

SEQ ID NO: 2608 - protein, 8 aa, Unknown
  Description of Unknown: Linker Sequence
DFDSGSLR

SEQ ID NO: 2609 - protein, 9 aa, Unknown
  Description of Unknown: Linker Sequence
KNGDNDFRY

SEQ ID NO: 2610 - protein, 11 aa, Unknown
  Description of Unknown: Linker Sequence
PMNVFYKDSLF

SEQ ID NO: 2611 - protein, 4 aa, Unknown
  Description of Unknown: Linker Sequence
GGEA

SEQ ID NO: 2612 - protein, 4 aa, Unknown
  Description of Unknown: Linker Sequence
LGDV

SEQ ID NO: 2613 - protein, 5 aa, Unknown
  Description of Unknown: Linker Sequence
YSNVE

SEQ ID NO: 2614 - protein, 6 aa, Unknown
  Description of Unknown: Linker Sequence
DPVSKE

SEQ ID NO: 2615 - protein, 6 aa, Unknown
  Description of Unknown: Linker Sequence
GLPGDK

SEQ ID NO: 2616 - protein, 6 aa, Unknown
  Description of Unknown: Linker Sequence
IVPPGQ

SEQ ID NO: 2617 - protein, 9 aa, Unknown
  Description of Unknown: Linker Sequence
TVPIAQDQV

SEQ ID NO: 2618 - protein, 11 aa, Unknown
  Description of Unknown: Linker Sequence
EVPKNETKENG

SEQ ID NO: 2619 - protein, 12 aa, Unknown
  Description of Unknown: Linker Sequence
MYYQQPGQQLAT

SEQ ID NO: 2620 - protein, 16 aa, Unknown
  Description of Unknown: Linker Sequence
QPGCSSGQACENALPV

SEQ ID NO: 2621 - protein, 15 aa, Unknown
  Description of Unknown: Linker Sequence
ALGGEARLPVLKDRN

SEQ ID NO: 2622 - protein, 8 aa, Unknown
  Description of Unknown: Linker Sequence
KYTYEHDP

SEQ ID NO: 2623 - protein, 10 aa, Unknown
  Description of Unknown: Linker Sequence
IGGPPNACLD

SEQ ID NO: 2624 - protein, 20 aa, Unknown
  Description of Unknown: Linker Sequence
ENAQRFNQAQSGNIQSTVML

SEQ ID NO: 2625 - protein, 25 aa, Unknown
  Description of Unknown: Linker Sequence
LQNREHETNGVAKSDQKQEQLLLKK

SEQ ID NO: 2626 - protein, 9 aa, Unknown
  Description of Unknown: Linker Sequence
CEMGSTFQL

SEQ ID NO: 2627 - protein, 26 aa, Unknown
  Description of Unknown: Linker Sequence
PDGRNQNPDLTGLCEPTPQDHIKVTQ

SEQ ID NO: 2628 - protein, 4 aa, Unknown
  Description of Unknown: Linker Sequence
LGTA

SEQ ID NO: 2629 - protein, 4 aa, Unknown
  Description of Unknown: Linker Sequence
NHPA

SEQ ID NO: 2630 - protein, 5 aa, Unknown
  Description of Unknown: Linker Sequence
CNLTP

SEQ ID NO: 2631 - protein, 5 aa, Unknown
  Description of Unknown: Linker Sequence
IRRTS

SEQ ID NO: 2632 - protein, 6 aa, Unknown
  Description of Unknown: Linker Sequence
KYLPVK

SEQ ID NO: 2633 - protein, 7 aa, Unknown
  Description of Unknown: Linker Sequence
ISGTPIQ

SEQ ID NO: 2634 - protein, 8 aa, Unknown
  Description of Unknown: Linker Sequence
RDADASDK

SEQ ID NO: 2635 - protein, 9 aa, Unknown
  Description of Unknown: Linker Sequence
TGEEGFDGA

SEQ ID NO: 2636 - protein, 10 aa, Unknown
  Description of Unknown: Linker Sequence
ESLQTGKISV

SEQ ID NO: 2637 - protein, 14 aa, Unknown
  Description of Unknown: Linker Sequence
DLFPQNYSTKAVEP

SEQ ID NO: 2638 - protein, 4 aa, Unknown
  Description of Unknown: Linker Sequence
SATH

SEQ ID NO: 2639 - protein, 7 aa, Unknown
  Description of Unknown: Linker Sequence
YIPLPEP

SEQ ID NO: 2640 - protein, 8 aa, Unknown
  Description of Unknown: Linker Sequence
RKTDGYSG

SEQ ID NO: 2641 - protein, 9 aa, Unknown
  Description of Unknown: Linker Sequence
PSRADPNHL

SEQ ID NO: 2642 - protein, 10 aa, Unknown
  Description of Unknown: Linker Sequence
LGTTQNSLTE

SEQ ID NO: 2643 - protein, 9 aa, Unknown
  Description of Unknown: Linker Sequence
NLLGQQPLV

SEQ ID NO: 2644 - protein, 10 aa, Unknown
  Description of Unknown: Linker Sequence
SSYGPASGPL

SEQ ID NO: 2645 - protein, 11 aa, Unknown
  Description of Unknown: Linker Sequence
VAQLPKKQVYI

SEQ ID NO: 2646 - protein, 16 aa, Unknown
  Description of Unknown: Linker Sequence
SATPQGQTAKIEVPHT

SEQ ID NO: 2647 - protein, 4 aa, Unknown
  Description of Unknown: Linker Sequence
FSCS

SEQ ID NO: 2648 - protein, 8 aa, Unknown
  Description of Unknown: Linker Sequence
FWLAIDMS

SEQ ID NO: 2649 - protein, 9 aa, Unknown
  Description of Unknown: Linker Sequence
VKAAPQAPV

SEQ ID NO: 2650 - protein, 13 aa, Unknown
  Description of Unknown: Linker Sequence
ADQSESQMIPKDS

SEQ ID NO: 2651 - protein, 4 aa, Unknown
  Description of Unknown: Linker Sequence
FAFI

SEQ ID NO: 2652 - protein, 4 aa, Unknown
  Description of Unknown: Linker Sequence
IQNT

SEQ ID NO: 2653 - protein, 5 aa, Unknown
  Description of Unknown: Linker Sequence
GTLSP

SEQ ID NO: 2654 - protein, 6 aa, Unknown
  Description of Unknown: Linker Sequence
QVPQDD

SEQ ID NO: 2655 - protein, 8 aa, Unknown
  Description of Unknown: Linker Sequence
HLSAGCPH

SEQ ID NO: 2656 - protein, 11 aa, Unknown
  Description of Unknown: Linker Sequence
FSTRVLPAQAT

SEQ ID NO: 2657 - protein, 4 aa, Unknown
  Description of Unknown: Linker Sequence
EMDS

SEQ ID NO: 2658 - protein, 5 aa, Unknown
  Description of Unknown: Linker Sequence
HFPLK

SEQ ID NO: 2659 - protein, 6 aa, Unknown
  Description of Unknown: Linker Sequence
DLDNVT

SEQ ID NO: 2660 - protein, 6 aa, Unknown
  Description of Unknown: Linker Sequence
FDGQLE

SEQ ID NO: 2661 - protein, 7 aa, Unknown
  Description of Unknown: Linker Sequence
ITNECQW

SEQ ID NO: 2662 - protein, 7 aa, Unknown
  Description of Unknown: Linker Sequence
SQPFPVV

SEQ ID NO: 2663 - protein, 7 aa, Unknown
  Description of Unknown: Linker Sequence
TGARSNF

SEQ ID NO: 2664 - protein, 8 aa, Unknown
  Description of Unknown: Linker Sequence
ESDASNPF

SEQ ID NO: 2665 - protein, 8 aa, Unknown
  Description of Unknown: Linker Sequence
HFFGNRSI

SEQ ID NO: 2666 - protein, 9 aa, Unknown
  Description of Unknown: Linker Sequence
QPIYPATLT

SEQ ID NO: 2667 - protein, 10 aa, Unknown
  Description of Unknown: Linker Sequence
FLAGTRKCSV

SEQ ID NO: 2668 - protein, 12 aa, Unknown
  Description of Unknown: Linker Sequence
LNPQHSAPKPNV

SEQ ID NO: 2669 - protein, 12 aa, Unknown
  Description of Unknown: Linker Sequence
SKGKQLGENQLV

SEQ ID NO: 2670 - protein, 15 aa, Unknown
  Description of Unknown: Linker Sequence
ATKQDPVRPKRPLSS

SEQ ID NO: 2671 - protein, 16 aa, Unknown
  Description of Unknown: Linker Sequence
ICDSHPTNKNNPTTPL

SEQ ID NO: 2672 - protein, 9 aa, Unknown
  Description of Unknown: Linker Sequence
YLDTKPAPV

SEQ ID NO: 2673 - protein, 4 aa, Unknown
  Description of Unknown: Linker Sequence
IHKK

SEQ ID NO: 2674 - protein, 5 aa, Unknown
  Description of Unknown: Linker Sequence
GIMPG

SEQ ID NO: 2675 - protein, 5 aa, Unknown
  Description of Unknown: Linker Sequence
NPGEC

SEQ ID NO: 2676 - protein, 7 aa, Unknown
  Description of Unknown: Linker Sequence
IGPNCPG

SEQ ID NO: 2677 - protein, 8 aa, Unknown
  Description of Unknown: Linker Sequence
CITEGIPQ

SEQ ID NO: 2678 - protein, 8 aa, Unknown
  Description of Unknown: Linker Sequence
LLRQGKTR

SEQ ID NO: 2679 - protein, 4 aa, Unknown
  Description of Unknown: Linker Sequence
MRDQ

SEQ ID NO: 2680 - protein, 4 aa, Unknown
  Description of Unknown: Linker Sequence
QEDP

SEQ ID NO: 2681 - protein, 5 aa, Unknown
  Description of Unknown: Linker Sequence
CLDGK

SEQ ID NO: 2682 - protein, 5 aa, Unknown
  Description of Unknown: Linker Sequence
QWELN

SEQ ID NO: 2683 - protein, 6 aa, Unknown
  Description of Unknown: Linker Sequence
ALDGNI

SEQ ID NO: 2684 - protein, 6 aa, Unknown
  Description of Unknown: Linker Sequence
TKQGDL

SEQ ID NO: 2685 - protein, 31 aa, Unknown
  Description of Unknown: Linker Sequence
KGEKYEKRIERLSVRKEEDVKTRSGKLGDNV

SEQ ID NO: 2686 - protein, 27 aa, Unknown
  Description of Unknown: Linker Sequence
AEDRPLSRELPAPAGGPVALSLHDEPT

SEQ ID NO: 2687 - protein, 9 aa, Unknown
  Description of Unknown: Linker Sequence
PYQKTSIPK

SEQ ID NO: 2688 - protein, 9 aa, Unknown
  Description of Unknown: Linker Sequence
RGAGKPNSS

SEQ ID NO: 2689 - protein, 6 aa, Unknown
  Description of Unknown: Linker Sequence
AVGKNP

SEQ ID NO: 2690 - protein, 6 aa, Unknown
  Description of Unknown: Linker Sequence
DTATNT

SEQ ID NO: 2691 - protein, 6 aa, Unknown
  Description of Unknown: Linker Sequence
FLSEPV

SEQ ID NO: 2692 - protein, 6 aa, Unknown
  Description of Unknown: Linker Sequence
LSFCNT

SEQ ID NO: 2693 - protein, 7 aa, Unknown
  Description of Unknown: Linker Sequence
SNITSGY

SEQ ID NO: 2694 - protein, 7 aa, Unknown
  Description of Unknown: Linker Sequence
VTPDGKK

SEQ ID NO: 2695 - protein, 7 aa, Unknown
  Description of Unknown: Linker Sequence
YASGQFI

SEQ ID NO: 2696 - protein, 13 aa, Unknown
  Description of Unknown: Linker Sequence
SIPVQPVYPSADF

SEQ ID NO: 2697 - protein, 7 aa, Unknown
  Description of Unknown: Linker Sequence
EIPTSNI

SEQ ID NO: 2698 - protein, 8 aa, Unknown
  Description of Unknown: Linker Sequence
KADFPTPS

SEQ ID NO: 2699 - protein, 10 aa, Unknown
  Description of Unknown: Linker Sequence
HPYIQNPDPA

SEQ ID NO: 2700 - protein, 11 aa, Unknown
  Description of Unknown: Linker Sequence
DTPPNFLDDDM

SEQ ID NO: 2701 - protein, 7 aa, Unknown
  Description of Unknown: Linker Sequence
FCKALNP

SEQ ID NO: 2702 - protein, 13 aa, Unknown
  Description of Unknown: Linker Sequence
HHDYSLPAAGESW

SEQ ID NO: 2703 - protein, 4 aa, Unknown
  Description of Unknown: Linker Sequence
AEGV

SEQ ID NO: 2704 - protein, 7 aa, Unknown
  Description of Unknown: Linker Sequence
LMLIADV

SEQ ID NO: 2705 - protein, 8 aa, Unknown
  Description of Unknown: Linker Sequence
EAGEEGEK

SEQ ID NO: 2706 - protein, 22 aa, Unknown
  Description of Unknown: Linker Sequence
RSTPPPEMPKPVPRKEVQAGVE

SEQ ID NO: 2707 - protein, 6 aa, Unknown
  Description of Unknown: Linker Sequence
CVPLVR

SEQ ID NO: 2708 - protein, 6 aa, Unknown
  Description of Unknown: Linker Sequence
KSDPIQ

SEQ ID NO: 2709 - protein, 4 aa, Unknown
  Description of Unknown: Linker Sequence
AGVE

SEQ ID NO: 2710 - protein, 12 aa, Unknown
  Description of Unknown: Linker Sequence
NAGGELFRDVNV

SEQ ID NO: 2711 - protein, 17 aa, Unknown
  Description of Unknown: Linker Sequence
ERGAWSAPLPRQPRADT

SEQ ID NO: 2712 - protein, 19 aa, Unknown
  Description of Unknown: Linker Sequence
LAGQQLEHGQTRRFGAISQ

SEQ ID NO: 2713 - protein, 4 aa, Unknown
  Description of Unknown: Linker Sequence
IDNG

SEQ ID NO: 2714 - protein, 4 aa, Unknown
  Description of Unknown: Linker Sequence
KVSW

SEQ ID NO: 2715 - protein, 5 aa, Unknown
  Description of Unknown: Linker Sequence
NRGES

SEQ ID NO: 2716 - protein, 6 aa, Unknown
  Description of Unknown: Linker Sequence
ITAKDE

SEQ ID NO: 2717 - protein, 6 aa, Unknown
  Description of Unknown: Linker Sequence
LWPHTK

SEQ ID NO: 2718 - protein, 6 aa, Unknown
  Description of Unknown: Linker Sequence
MAIGPV

SEQ ID NO: 2719 - protein, 8 aa, Unknown
  Description of Unknown: Linker Sequence
AEKNYDVI

SEQ ID NO: 2720 - protein, 8 aa, Unknown
  Description of Unknown: Linker Sequence
DLDRTLTQ

SEQ ID NO: 2721 - protein, 9 aa, Unknown
  Description of Unknown: Linker Sequence
NIAHDDKPG

SEQ ID NO: 2722 - protein, 4 aa, Unknown
  Description of Unknown: Linker Sequence
FFDK

SEQ ID NO: 2723 - protein, 6 aa, Unknown
  Description of Unknown: Linker Sequence
LFSNDE

SEQ ID NO: 2724 - protein, 6 aa, Unknown
  Description of Unknown: Linker Sequence
VTPGSE

SEQ ID NO: 2725 - protein, 7 aa, Unknown
  Description of Unknown: Linker Sequence
ERKERDH

SEQ ID NO: 2726 - protein, 12 aa, Unknown
  Description of Unknown: Linker Sequence
FDIDQNISSDDF

SEQ ID NO: 2727 - protein, 17 aa, Unknown
  Description of Unknown: Linker Sequence
ELIDAIPEDENVTLYSQ

SEQ ID NO: 2728 - protein, 19 aa, Unknown
  Description of Unknown: Linker Sequence
TMKQIVNENMKIERKVVSR

SEQ ID NO: 2729 - protein, 23 aa, Unknown
  Description of Unknown: Linker Sequence
AHAIKRLYGNVKFGVGPVIEGGF

SEQ ID NO: 2730 - protein, 21 aa, Unknown
  Description of Unknown: Linker Sequence
INGGWGPWSPWDICSVTCGGG

SEQ ID NO: 2731 - protein, 16 aa, Unknown
  Description of Unknown: Linker Sequence
LKMKGLTYTMCDKTKF

SEQ ID NO: 2732 - protein, 7 aa, Unknown
  Description of Unknown: Linker Sequence
LRGEVVS

SEQ ID NO: 2733 - protein, 10 aa, Unknown
  Description of Unknown: Linker Sequence
IHLPKTLEGM

SEQ ID NO: 2734 - protein, 4 aa, Unknown
  Description of Unknown: Linker Sequence
PYPV

SEQ ID NO: 2735 - protein, 14 aa, Unknown
  Description of Unknown: Linker Sequence
LNKEGEPTKQRTRD

SEQ ID NO: 2736 - protein, 11 aa, Unknown
  Description of Unknown: Linker Sequence
RFRDRLPEKLR

SEQ ID NO: 2737 - protein, 12 aa, Unknown
  Description of Unknown: Linker Sequence
DAPQQDPEGNKT

SEQ ID NO: 2738 - protein, 4 aa, Unknown
  Description of Unknown: Linker Sequence
ELPL

SEQ ID NO: 2739 - protein, 4 aa, Unknown
  Description of Unknown: Linker Sequence
VHGK

SEQ ID NO: 2740 - protein, 5 aa, Unknown
  Description of Unknown: Linker Sequence
TNTEK

SEQ ID NO: 2741 - protein, 9 aa, Unknown
  Description of Unknown: Linker Sequence
DSPLKYWPK

SEQ ID NO: 2742 - protein, 12 aa, Unknown
  Description of Unknown: Linker Sequence
SCSEPRCFNGGT

SEQ ID NO: 2743 - protein, 4 aa, Unknown
  Description of Unknown: Linker Sequence
IDGK

SEQ ID NO: 2744 - protein, 5 aa, Unknown
  Description of Unknown: Linker Sequence
PLEGT

SEQ ID NO: 2745 - protein, 9 aa, Unknown
  Description of Unknown: Linker Sequence
AMPGWQDKV

SEQ ID NO: 2746 - protein, 8 aa, Unknown
  Description of Unknown: Linker Sequence
YKKTARPK

SEQ ID NO: 2747 - protein, 12 aa, Unknown
  Description of Unknown: Linker Sequence
TWAPHPRPLPQA

SEQ ID NO: 2748 - protein, 7 aa, Unknown
  Description of Unknown: Linker Sequence
ELNEEMP

SEQ ID NO: 2749 - protein, 17 aa, Unknown
  Description of Unknown: Linker Sequence
IVDYSPQQEGKVFFGAW

SEQ ID NO: 2750 - protein, 6 aa, Unknown
  Description of Unknown: Linker Sequence
QRVRNR

SEQ ID NO: 2751 - protein, 5 aa, Unknown
  Description of Unknown: Linker Sequence
LFVKP

SEQ ID NO: 2752 - protein, 6 aa, Unknown
  Description of Unknown: Linker Sequence
NLNLTP

SEQ ID NO: 2753 - protein, 18 aa, Unknown
  Description of Unknown: Linker Sequence
YSKKAPPQEEIEFVGEHP

SEQ ID NO: 2754 - protein, 4 aa, Unknown
  Description of Unknown: Linker Sequence
IHSP

SEQ ID NO: 2755 - protein, 4 aa, Unknown
  Description of Unknown: Linker Sequence
LTDS

SEQ ID NO: 2756 - protein, 5 aa, Unknown
  Description of Unknown: Linker Sequence
KDGRL

SEQ ID NO: 2757 - protein, 9 aa, Unknown
  Description of Unknown: Linker Sequence
ARINEREET

SEQ ID NO: 2758 - protein, 19 aa, Unknown
  Description of Unknown: Linker Sequence
LWNCAPPQSEVVYRPLVSL

SEQ ID NO: 2759 - protein, 5 aa, Unknown
  Description of Unknown: Linker Sequence
EFPEV

SEQ ID NO: 2760 - protein, 7 aa, Unknown
  Description of Unknown: Linker Sequence
RTASHSI

SEQ ID NO: 2761 - protein, 21 aa, Unknown
  Description of Unknown: Linker Sequence
EDGVIRRRVALLDPVKVNTKV

SEQ ID NO: 2762 - protein, 9 aa, Unknown
  Description of Unknown: Linker Sequence
VLAGGKSGV

SEQ ID NO: 2763 - protein, 4 aa, Unknown
  Description of Unknown: Linker Sequence
QKHV

SEQ ID NO: 2764 - protein, 5 aa, Unknown
  Description of Unknown: Linker Sequence
VAPLI

SEQ ID NO: 2765 - protein, 6 aa, Unknown
  Description of Unknown: Linker Sequence
AADTGL

SEQ ID NO: 2766 - protein, 6 aa, Unknown
  Description of Unknown: Linker Sequence
FANDPQ

SEQ ID NO: 2767 - protein, 6 aa, Unknown
  Description of Unknown: Linker Sequence
LLDHHQ

SEQ ID NO: 2768 - protein, 9 aa, Unknown
  Description of Unknown: Linker Sequence
SSPHALGVI

SEQ ID NO: 2769 - protein, 11 aa, Unknown
  Description of Unknown: Linker Sequence
SERSFPDDLNM

SEQ ID NO: 2770 - protein, 21 aa, Unknown
  Description of Unknown: Linker Sequence
DMGYLGPDPVARSLRTRRAGA

SEQ ID NO: 2771 - protein, 4 aa, Unknown
  Description of Unknown: Linker Sequence
ELPL

SEQ ID NO: 2772 - protein, 5 aa, Unknown
  Description of Unknown: Linker Sequence
EMPSL

SEQ ID NO: 2773 - protein, 5 aa, Unknown
  Description of Unknown: Linker Sequence
RREDI

SEQ ID NO: 2774 - protein, 8 aa, Unknown
  Description of Unknown: Linker Sequence
IHYDWPGN

SEQ ID NO: 2775 - protein, 9 aa, Unknown
  Description of Unknown: Linker Sequence
LLTGEYISE

SEQ ID NO: 2776 - protein, 11 aa, Unknown
  Description of Unknown: Linker Sequence
RNRKVVKGFTP

SEQ ID NO: 2777 - protein, 17 aa, Unknown
  Description of Unknown: Linker Sequence
IAATPIKTEYSGEIQPL

SEQ ID NO: 2778 - protein, 4 aa, Unknown
  Description of Unknown: Linker Sequence
NQYR

SEQ ID NO: 2779 - protein, 7 aa, Unknown
  Description of Unknown: Linker Sequence
EMGLSLQ

SEQ ID NO: 2780 - protein, 7 aa, Unknown
  Description of Unknown: Linker Sequence
KDSAQNS

SEQ ID NO: 2781 - protein, 11 aa, Unknown
  Description of Unknown: Linker Sequence
HDVELNLDYEE

SEQ ID NO: 2782 - protein, 5 aa, Unknown
  Description of Unknown: Linker Sequence
PVDAQ

SEQ ID NO: 2783 - protein, 5 aa, Unknown
  Description of Unknown: Linker Sequence
VPIIE

SEQ ID NO: 2784 - protein, 7 aa, Unknown
  Description of Unknown: Linker Sequence
GVFDGGK

SEQ ID NO: 2785 - protein, 4 aa, Unknown
  Description of Unknown: Linker Sequence
YLRE

SEQ ID NO: 2786 - protein, 6 aa, Unknown
  Description of Unknown: Linker Sequence
IEEDSP

SEQ ID NO: 2787 - protein, 5 aa, Unknown
  Description of Unknown: Linker Sequence
RKSFL

SEQ ID NO: 2788 - protein, 7 aa, Unknown
  Description of Unknown: Linker Sequence
DILDDDR

SEQ ID NO: 2789 - protein, 7 aa, Unknown
  Description of Unknown: Linker Sequence
SGKGGDK

SEQ ID NO: 2790 - protein, 15 aa, Unknown
  Description of Unknown: Linker Sequence
MGGTFTDKDPFRSGR

SEQ ID NO: 2791 - protein, 4 aa, Unknown
  Description of Unknown: Linker Sequence
VEER

SEQ ID NO: 2792 - protein, 7 aa, Unknown
  Description of Unknown: Linker Sequence
ELPELTA

SEQ ID NO: 2793 - protein, 11 aa, Unknown
  Description of Unknown: Linker Sequence
IKRFGVEDGSV

SEQ ID NO: 2794 - protein, 4 aa, Unknown
  Description of Unknown: Linker Sequence
AYRW

SEQ ID NO: 2795 - protein, 4 aa, Unknown
  Description of Unknown: Linker Sequence
EDAL

SEQ ID NO: 2796 - protein, 7 aa, Unknown
  Description of Unknown: Linker Sequence
IRTVGEA

SEQ ID NO: 2797 - protein, 15 aa, Unknown
  Description of Unknown: Linker Sequence
ETGLNAYLPGLAGKE

SEQ ID NO: 2798 - protein, 9 aa, Unknown
  Description of Unknown: Linker Sequence
LEGRIKGKE

SEQ ID NO: 2799 - protein, 5 aa, Unknown
  Description of Unknown: Linker Sequence
RMRNF

SEQ ID NO: 2800 - protein, 6 aa, Unknown
  Description of Unknown: Linker Sequence
RGVLPE

SEQ ID NO: 2801 - protein, 6 aa, Unknown
  Description of Unknown: Linker Sequence
SLEEQR

SEQ ID NO: 2802 - protein, 7 aa, Unknown
  Description of Unknown: Linker Sequence
ANQLQNY

SEQ ID NO: 2803 - protein, 7 aa, Unknown
  Description of Unknown: Linker Sequence
NYLLPAG

SEQ ID NO: 2804 - protein, 14 aa, Unknown
  Description of Unknown: Linker Sequence
LDWQPRENPFQNLK

SEQ ID NO: 2805 - protein, 4 aa, Unknown
  Description of Unknown: Linker Sequence
RIQM

SEQ ID NO: 2806 - protein, 4 aa, Unknown
  Description of Unknown: Linker Sequence
WTDP

SEQ ID NO: 2807 - protein, 5 aa, Unknown
  Description of Unknown: Linker Sequence
ELGLL

SEQ ID NO: 2808 - protein, 7 aa, Unknown
  Description of Unknown: Linker Sequence
APSHGQI

SEQ ID NO: 2809 - protein, 8 aa, Unknown
  Description of Unknown: Linker Sequence
ATGMVDER

SEQ ID NO: 2810 - protein, 5 aa, Unknown
  Description of Unknown: Linker Sequence
FSLDE

SEQ ID NO: 2811 - protein, 6 aa, Unknown
  Description of Unknown: Linker Sequence
HWKLEA

SEQ ID NO: 2812 - protein, 4 aa, Unknown
  Description of Unknown: Linker Sequence
SEIG

SEQ ID NO: 2813 - protein, 8 aa, Unknown
  Description of Unknown: Linker Sequence
KGIGHSRF

SEQ ID NO: 2814 - protein, 5 aa, Unknown
  Description of Unknown: Linker Sequence
EGIKD

SEQ ID NO: 2815 - protein, 7 aa, Unknown
  Description of Unknown: Linker Sequence
LSRFPTP

SEQ ID NO: 2816 - protein, 15 aa, Unknown
  Description of Unknown: Linker Sequence
LLSPYHHVSGYSPRY

SEQ ID NO: 2817 - protein, 4 aa, Unknown
  Description of Unknown: Linker Sequence
PGDW

SEQ ID NO: 2818 - protein, 6 aa, Unknown
  Description of Unknown: Linker Sequence
DINKNE

SEQ ID NO: 2819 - protein, 6 aa, Unknown
  Description of Unknown: Linker Sequence
ITPYAE

SEQ ID NO: 2820 - protein, 7 aa, Unknown
  Description of Unknown: Linker Sequence
EFQSIGD

SEQ ID NO: 2821 - protein, 7 aa, Unknown
  Description of Unknown: Linker Sequence
KDPEGNV

SEQ ID NO: 2822 - protein, 7 aa, Unknown
  Description of Unknown: Linker Sequence
SLSVIGE

SEQ ID NO: 2823 - protein, 7 aa, Unknown
  Description of Unknown: Linker Sequence
SPVNSKR

SEQ ID NO: 2824 - protein, 8 aa, Unknown
  Description of Unknown: Linker Sequence
ENTRGFHG

SEQ ID NO: 2825 - protein, 8 aa, Unknown
  Description of Unknown: Linker Sequence
NNLKRDYT

SEQ ID NO: 2826 - protein, 10 aa, Unknown
  Description of Unknown: Linker Sequence
KYEDFRSPSA

SEQ ID NO: 2827 - protein, 24 aa, Unknown
  Description of Unknown: Linker Sequence
YPRLTNKIPKPPQEVKPHPYGVDR

SEQ ID NO: 2828 - protein, 7 aa, Unknown
  Description of Unknown: Linker Sequence
ARDRSYE

SEQ ID NO: 2829 - protein, 13 aa, Unknown
  Description of Unknown: Linker Sequence
VTSTVKNDIYAHI

SEQ ID NO: 2830 - protein, 22 aa, Unknown
  Description of Unknown: Linker Sequence
PYSERYGYRPALIPRPVMAGTL

SEQ ID NO: 2831 - protein, 5 aa, Unknown
  Description of Unknown: Linker Sequence
VSQPG

SEQ ID NO: 2832 - protein, 6 aa, Unknown
  Description of Unknown: Linker Sequence
LEGLPY

SEQ ID NO: 2833 - protein, 4 aa, Unknown
  Description of Unknown: Linker Sequence
QPGV

SEQ ID NO: 2834 - protein, 5 aa, Unknown
  Description of Unknown: Linker Sequence
WKLEG

SEQ ID NO: 2835 - protein, 6 aa, Unknown
  Description of Unknown: Linker Sequence
TAYNAP

SEQ ID NO: 2836 - protein, 11 aa, Unknown
  Description of Unknown: Linker Sequence
HKHDLSETNVY

SEQ ID NO: 2837 - protein, 7 aa, Unknown
  Description of Unknown: Linker Sequence
VLQAVTD

SEQ ID NO: 2838 - protein, 4 aa, Unknown
  Description of Unknown: Linker Sequence
YKDK

SEQ ID NO: 2839 - protein, 6 aa, Unknown
  Description of Unknown: Linker Sequence
NLPFNM

SEQ ID NO: 2840 - protein, 6 aa, Unknown
  Description of Unknown: Linker Sequence
WGVKDP

SEQ ID NO: 2841 - protein, 13 aa, Unknown
  Description of Unknown: Linker Sequence
QKKKYGDKVPENL

SEQ ID NO: 2842 - protein, 14 aa, Unknown
  Description of Unknown: Linker Sequence
NDLVEFNRFTNSPL

SEQ ID NO: 2843 - protein, 10 aa, Unknown
  Description of Unknown: Linker Sequence
LKEQESPVKV

SEQ ID NO: 2844 - protein, 6 aa, Unknown
  Description of Unknown: Linker Sequence
EEGIAN

SEQ ID NO: 2845 - protein, 11 aa, Unknown
  Description of Unknown: Linker Sequence
ADFQGAGRRFD

SEQ ID NO: 2846 - protein, 6 aa, Unknown
  Description of Unknown: Linker Sequence
AAGLPR

SEQ ID NO: 2847 - protein, 10 aa, Unknown
  Description of Unknown: Linker Sequence
TFTGLPHRFE

SEQ ID NO: 2848 - protein, 4 aa, Unknown
  Description of Unknown: Linker Sequence
TTVD

SEQ ID NO: 2849 - protein, 4 aa, Unknown
  Description of Unknown: Linker Sequence
DNLR

SEQ ID NO: 2850 - protein, 5 aa, Unknown
  Description of Unknown: Linker Sequence
FYHEP

SEQ ID NO: 2851 - protein, 6 aa, Unknown
  Description of Unknown: Linker Sequence
ALGYPL

SEQ ID NO: 2852 - protein, 6 aa, Unknown
  Description of Unknown: Linker Sequence
LLGEIS

SEQ ID NO: 2853 - protein, 6 aa, Unknown
  Description of Unknown: Linker Sequence
MGTVGN

SEQ ID NO: 2854 - protein, 6 aa, Unknown
  Description of Unknown: Linker Sequence
TGTNGK

SEQ ID NO: 2855 - protein, 10 aa, Unknown
  Description of Unknown: Linker Sequence
RLQPVCGRME

SEQ ID NO: 2856 - protein, 12 aa, Unknown
  Description of Unknown: Linker Sequence
TSEAHEKPEEKR

SEQ ID NO: 2857 - protein, 16 aa, Unknown
  Description of Unknown: Linker Sequence
NFGGYFPNKLAEYHDF

SEQ ID NO: 2858 - protein, 15 aa, Unknown
  Description of Unknown: Linker Sequence
RFAPPTWERIYPLDL

SEQ ID NO: 2859 - protein, 4 aa, Unknown
  Description of Unknown: Linker Sequence
VFQP

SEQ ID NO: 2860 - protein, 13 aa, Unknown
  Description of Unknown: Linker Sequence
EKASPAFYPQGQE

SEQ ID NO: 2861 - protein, 35 aa, Unknown
  Description of Unknown: Linker Sequence
SMAVRFAKVPPDAAKAFIADRSMLFNGGTASRPPV

SEQ ID NO: 2862 - protein, 4 aa, Unknown
  Description of Unknown: Linker Sequence
VLKL

SEQ ID NO: 2863 - protein, 6 aa, Unknown
  Description of Unknown: Linker Sequence
DLKNSK

SEQ ID NO: 2864 - protein, 9 aa, Unknown
  Description of Unknown: Linker Sequence
LKKDFQGVE

SEQ ID NO: 2865 - protein, 4 aa, Unknown
  Description of Unknown: Linker Sequence
GYTG

SEQ ID NO: 2866 - protein, 4 aa, Unknown
  Description of Unknown: Linker Sequence
PMSD

SEQ ID NO: 2867 - protein, 4 aa, Unknown
  Description of Unknown: Linker Sequence
SDPE

SEQ ID NO: 2868 - protein, 5 aa, Unknown
  Description of Unknown: Linker Sequence
DAPGQ

SEQ ID NO: 2869 - protein, 5 aa, Unknown
  Description of Unknown: Linker Sequence
FEQTL

SEQ ID NO: 2870 - protein, 5 aa, Unknown
  Description of Unknown: Linker Sequence
GGLSQ

SEQ ID NO: 2871 - protein, 6 aa, Unknown
  Description of Unknown: Linker Sequence
AGENEI

SEQ ID NO: 2872 - protein, 6 aa, Unknown
  Description of Unknown: Linker Sequence
QRCGFV

SEQ ID NO: 2873 - protein, 6 aa, Unknown
  Description of Unknown: Linker Sequence
RQREGT

SEQ ID NO: 2874 - protein, 7 aa, Unknown
  Description of Unknown: Linker Sequence
HGNNPLA

SEQ ID NO: 2875 - protein, 8 aa, Unknown
  Description of Unknown: Linker Sequence
GAHYRTSP

SEQ ID NO: 2876 - protein, 8 aa, Unknown
  Description of Unknown: Linker Sequence
QYTQDLDY

SEQ ID NO: 2877 - protein, 11 aa, Unknown
  Description of Unknown: Linker Sequence
WAGFRRPRGNL

SEQ ID NO: 2878 - protein, 13 aa, Unknown
  Description of Unknown: Linker Sequence
MGNHREASSGCYT

SEQ ID NO: 2879 - protein, 17 aa, Unknown
  Description of Unknown: Linker Sequence
LVFDDENFTHTPQGNIV

SEQ ID NO: 2880 - protein, 6 aa, Unknown
  Description of Unknown: Linker Sequence
ALPGFQ

SEQ ID NO: 2881 - protein, 14 aa, Unknown
  Description of Unknown: Linker Sequence
RASSVAERHVSPDT

SEQ ID NO: 2882 - protein, 7 aa, Unknown
  Description of Unknown: Linker Sequence
KISSGDW

SEQ ID NO: 2883 - protein, 7 aa, Unknown
  Description of Unknown: Linker Sequence
SKSKNPI

SEQ ID NO: 2884 - protein, 11 aa, Unknown
  Description of Unknown: Linker Sequence
FMNKDGCAGFT

SEQ ID NO: 2885 - protein, 4 aa, Unknown
  Description of Unknown: Linker Sequence
IMGS

SEQ ID NO: 2886 - protein, 4 aa, Unknown
  Description of Unknown: Linker Sequence
KPYK

SEQ ID NO: 2887 - protein, 5 aa, Unknown
  Description of Unknown: Linker Sequence
EGPPM

SEQ ID NO: 2888 - protein, 5 aa, Unknown
  Description of Unknown: Linker Sequence
LGAEI

SEQ ID NO: 2889 - protein, 5 aa, Unknown
  Description of Unknown: Linker Sequence
YIPEK

SEQ ID NO: 2890 - protein, 6 aa, Unknown
  Description of Unknown: Linker Sequence
GEKLNI

SEQ ID NO: 2891 - protein, 6 aa, Unknown
  Description of Unknown: Linker Sequence
NKGYHI

SEQ ID NO: 2892 - protein, 7 aa, Unknown
  Description of Unknown: Linker Sequence
CIETGEI

SEQ ID NO: 2893 - protein, 11 aa, Unknown
  Description of Unknown: Linker Sequence
TGNPLLWSDDL

SEQ ID NO: 2894 - protein, 8 aa, Unknown
  Description of Unknown: Linker Sequence
KHEYQDRF

SEQ ID NO: 2895 - protein, 9 aa, Unknown
  Description of Unknown: Linker Sequence
CRFGYRDSI

SEQ ID NO: 2896 - protein, 9 aa, Unknown
  Description of Unknown: Linker Sequence
RLDPTTVTP

SEQ ID NO: 2897 - protein, 11 aa, Unknown
  Description of Unknown: Linker Sequence
PKEWQPVLTYG

SEQ ID NO: 2898 - protein, 19 aa, Unknown
  Description of Unknown: Linker Sequence
CNTTKCNEGPILELENLPQ

SEQ ID NO: 2899 - protein, 24 aa, Unknown
  Description of Unknown: Linker Sequence
CGLDLCNQGNSGRAVTYSRSRYLE

SEQ ID NO: 2900 - protein, 7 aa, Unknown
  Description of Unknown: Linker Sequence
SFPKDPE

SEQ ID NO: 2901 - protein, 8 aa, Unknown
  Description of Unknown: Linker Sequence
VRTEIAKK

SEQ ID NO: 2902 - protein, 14 aa, Unknown
  Description of Unknown: Linker Sequence
IIRKDQRLKFGEGI

SEQ ID NO: 2903 - protein, 11 aa, Unknown
  Description of Unknown: Linker Sequence
EQLLGTSFLTR

SEQ ID NO: 2904 - protein, 25 aa, Unknown
  Description of Unknown: Linker Sequence
PHDQCACGVLTSEKRAPDLQDLPWQ

SEQ ID NO: 2905 - protein, 8 aa, Unknown
  Description of Unknown: Linker Sequence
KVSGENHV

SEQ ID NO: 2906 - protein, 6 aa, Unknown
  Description of Unknown: Linker Sequence
NVAEDY

SEQ ID NO: 2907 - protein, 4 aa, Unknown
  Description of Unknown: Linker Sequence
IDWR

SEQ ID NO: 2908 - protein, 4 aa, Unknown
  Description of Unknown: Linker Sequence
RKGS

SEQ ID NO: 2909 - protein, 5 aa, Unknown
  Description of Unknown: Linker Sequence
LFKSP

SEQ ID NO: 2910 - protein, 8 aa, Unknown
  Description of Unknown: Linker Sequence
QNLTAPAT

SEQ ID NO: 2911 - protein, 6 aa, Unknown
  Description of Unknown: Linker Sequence
YAPRPR

SEQ ID NO: 2912 - protein, 7 aa, Unknown
  Description of Unknown: Linker Sequence
YGPDGQR

SEQ ID NO: 2913 - protein, 9 aa, Unknown
  Description of Unknown: Linker Sequence
VSQKTFPQL

SEQ ID NO: 2914 - protein, 17 aa, Unknown
  Description of Unknown: Linker Sequence
GVSDDDAFEVGLTCGGI

SEQ ID NO: 2915 - protein, 4 aa, Unknown
  Description of Unknown: Linker Sequence
FNDK

SEQ ID NO: 2916 - protein, 4 aa, Unknown
  Description of Unknown: Linker Sequence
HDRN

SEQ ID NO: 2917 - protein, 5 aa, Unknown
  Description of Unknown: Linker Sequence
KVKAD

SEQ ID NO: 2918 - protein, 6 aa, Unknown
  Description of Unknown: Linker Sequence
EAGISS

SEQ ID NO: 2919 - protein, 6 aa, Unknown
  Description of Unknown: Linker Sequence
IKASWA

SEQ ID NO: 2920 - protein, 6 aa, Unknown
  Description of Unknown: Linker Sequence
LTRGFA

SEQ ID NO: 2921 - protein, 7 aa, Unknown
  Description of Unknown: Linker Sequence
LNGRARA

SEQ ID NO: 2922 - protein, 7 aa, Unknown
  Description of Unknown: Linker Sequence
SLATFDS

SEQ ID NO: 2923 - protein, 8 aa, Unknown
  Description of Unknown: Linker Sequence
ALPEGHAK

SEQ ID NO: 2924 - protein, 8 aa, Unknown
  Description of Unknown: Linker Sequence
ATTGVEGL

SEQ ID NO: 2925 - protein, 8 aa, Unknown
  Description of Unknown: Linker Sequence
RPKSTEKL

SEQ ID NO: 2926 - protein, 9 aa, Unknown
  Description of Unknown: Linker Sequence
YTSRKKTHE

SEQ ID NO: 2927 - protein, 10 aa, Unknown
  Description of Unknown: Linker Sequence
ASPYHLGIND

SEQ ID NO: 2928 - protein, 10 aa, Unknown
  Description of Unknown: Linker Sequence
GLQDWNVTPE

SEQ ID NO: 2929 - protein, 10 aa, Unknown
  Description of Unknown: Linker Sequence
LDRKSGDYNQ

SEQ ID NO: 2930 - protein, 13 aa, Unknown
  Description of Unknown: Linker Sequence
LLDRDLNLNLPPV

SEQ ID NO: 2931 - protein, 13 aa, Unknown
  Description of Unknown: Linker Sequence
SEGLLPLDNHYHF

SEQ ID NO: 2932 - protein, 14 aa, Unknown
  Description of Unknown: Linker Sequence
ESPVDSEQRGENDL

SEQ ID NO: 2933 - protein, 15 aa, Unknown
  Description of Unknown: Linker Sequence
ALHDMNVELEEKTSH

SEQ ID NO: 2934 - protein, 15 aa, Unknown
  Description of Unknown: Linker Sequence
VDKAPYRFTHGWTYS

SEQ ID NO: 2935 - protein, 16 aa, Unknown
  Description of Unknown: Linker Sequence
HRGAHIYMNSWQSIDF

SEQ ID NO: 2936 - protein, 17 aa, Unknown
  Description of Unknown: Linker Sequence
RENGLVRSPGGFPGEDL

SEQ ID NO: 2937 - protein, 18 aa, Unknown
  Description of Unknown: Linker Sequence
VAGVGTRSSDGFQTSGDY

SEQ ID NO: 2938 - protein, 21 aa, Unknown
  Description of Unknown: Linker Sequence
EIHVEQKLPQKLSAKAKELPI

SEQ ID NO: 2939 - protein, 6 aa, Unknown
  Description of Unknown: Linker Sequence
RWQSFN

SEQ ID NO: 2940 - protein, 9 aa, Unknown
  Description of Unknown: Linker Sequence
SLTARPGFL

SEQ ID NO: 2941 - protein, 10 aa, Unknown
  Description of Unknown: Linker Sequence
LRIPFSEHLG

SEQ ID NO: 2942 - protein, 10 aa, Unknown
  Description of Unknown: Linker Sequence
VVGGQQGSLE

SEQ ID NO: 2943 - protein, 13 aa, Unknown
  Description of Unknown: Linker Sequence
DDFDKDTLNINFQ

SEQ ID NO: 2944 - protein, 13 aa, Unknown
  Description of Unknown: Linker Sequence
YGRESLQSKFTQA

SEQ ID NO: 2945 - protein, 18 aa, Unknown
  Description of Unknown: Linker Sequence
VEAPDLPQQEWAPTYEER

SEQ ID NO: 2946 - protein, 31 aa, Unknown
  Description of Unknown: Linker Sequence
IGCPGDTQGDTYLSKGDKRVNEDAVRGLKAE

SEQ ID NO: 2947 - protein, 20 aa, Unknown
  Description of Unknown: Linker Sequence
FQGYYLVSPSETFLERDVLK

SEQ ID NO: 2948 - protein, 422 aa, Artificial Sequence
  Description of Artificial Sequence: Synthetic polypeptide
MKKLLFAIPLVVPFYSHSAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPFSAGKPYEFSIDCDKINLFRGVFAFLLYVATFMYVFSTFANILRNKES

SEQ ID NO: 2949 - protein, 434 aa, Artificial Sequence
  Description of Artificial Sequence: Synthetic polypeptide
MKRKIIAISLFLYIPLSNADNWESITKSYYTGFAMSKTVESKDQDGKTVRKEVITQADLTTACNDAKASAQDVFNQMKLTFSGIWPDSQFRLVTGDTCVYNGSPSEKTESWSIRAQVEGDMQRSVPDEEPSEQTPEEICEAKPPIDGVFNNVSKGDEGGFYINYNGCEYEATGVTVCQNDGTVCASSAWKPTGYVPESGESSSSPVKDGDTGGTGEGGSDTGGDTGGGDTGGGSTGGDTGGSTGGGSTGGGSTGGSTGKSLTKEDVTAAIHDASPSIGDAVKDSLTEDNDQNDNQKKADEQSAKASASVSDAISDGMRGVGNFVDDLGGESSQYGIGNSEMDLSVSLAKGQLGIDLEGHGSAWESFLNDGALRPSIPSGHGCTDFVMFQGSVYQLDIGCDKLGDIKSVLSWVMYCLTFWYVFQSATSLLRKGEQ

SEQ ID NO: 2950 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNVKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2951 - protein, 424 aa, Artificial Sequence
  Description of Artificial Sequence: Synthetic polypeptide
MKKLLFAIPLVVPFYSHSAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPFVFSAGKPYEFSIDCDKINLFRGVFAFLLYVATFMYVFSTFANILRNKES

SEQ ID NO: 2952 - protein, 506 aa, Artificial Sequence
  Description of Artificial Sequence: Synthetic polypeptide
MYRMQLLSCIALSLALVTNSMAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTFTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGAMVRSPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2953 - protein, 509 aa, Artificial Sequence
  Description of Artificial Sequence: Synthetic polypeptide
MYRMQLLSCIALSLALVTNSMAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTFTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGAMVRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2954 - protein, 131 aa, Artificial Sequence
  Description of Artificial Sequence: Synthetic polypeptide
TKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNA

SEQ ID NO: 2955 - protein, 131 aa, Artificial Sequence; identical to SEQ ID NO: 2954
  Description of Artificial Sequence: Synthetic polypeptide

SEQ ID NO: 2956 - protein, 131 aa, Artificial Sequence; identical to SEQ ID NO: 2954
  Description of Artificial Sequence: Synthetic polypeptide

SEQ ID NO: 2957 - protein, 128 aa, Artificial Sequence
  Description of Artificial Sequence: Synthetic polypeptide
SPGEKTESWSIRAQVEGDIQRSVPDEEPSEQTPEEICEAKPPIDGVFNNVFKGDEGGFYINYNGCEYEATGVTVCQNDGTVCSSSAWKPTGYVPESGEPSSSPLKDGDTGGTGEGGSDTGGDTGGGDT

SEQ ID NO: 2958 - protein, 128 aa, Artificial Sequence
  Description of Artificial Sequence: Synthetic polypeptide
SPSEKTESWSIRAQVEGDMQRSVPDEEPSEQTPEEICEAKPPIDGVFNNVSKGDEGGFYINYNGCEYEATGVTVCQNDGTVCASSAWKPTGYVPESGESSSSPVKDGDTGGTGEGGSDTGGDTGGGDT

SEQ ID NO: 2959 - protein, 161 aa, Artificial Sequence
  Description of Artificial Sequence: Synthetic polypeptide
STPDTVTPGQTVNLPSDLSTLSIPANVVKSDSIGSQFSLYTNASCTMCSGYYLSNNADSIAIANITETVKADYNQPDMWFEQTDSDGNHVKILQNSYKAVSYNVESKQSDVNNPTYINYSYSVNVKQVSYDTSNVCIMNWETFQNKCDASRAVLITDTVTP

SEQ ID NO: 2960 - protein, 424 aa, Artificial Sequence
  Description of Artificial Sequence: Synthetic polypeptide
MKKLLFAIPLVVPFYSHSAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPYVFGAGKPYEFSIDCDKINLFRGVFAFLLYVATFMYVFSTFANILRNKES

SEQ ID NO: 2961 - protein, 227 aa, Artificial Sequence
  Description of Artificial Sequence: Synthetic polypeptide
MAETVESCLAKSHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDLFVCEYQGQSSDLPQPPVNAPSGHHHHHH

SEQ ID NO: 2962 - protein, 227 aa, Artificial Sequence; identical to SEQ ID NO: 2961
  Description of Artificial Sequence: Synthetic polypeptide

SEQ ID NO: 2963 - protein, 264 aa, Artificial Sequence
  Description of Artificial Sequence: Synthetic polypeptide
ATTDAECLSKPAFDGTLSNVWKEGDSRYANFENCIYELSGIGIGYDNDTSCNGHWTPVRAADGSGNGGDDNSSGGGSNGDSGNNSTPDTVTPGQTVNLPSDLSTLSIPANVVKSDSIGSQFSLYTNASCTMCSGYYLSNNADSIAIANITETVKADYNQPDMWFEQTDSDGNHVKILQNSYKAVSYNVESKQSDVNNPTYINYSYSVNVKQVSYDTSNVCIMNWETFQNKCDASRAVLITDTVTPSYSRNITIQSNINYQGSNG

SEQ ID NO: 2964 - protein, 424 aa, Artificial Sequence
  Description of Artificial Sequence: Synthetic polypeptide
MKKLLFAIPLVVPFYSHSAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGDFDYEKMANANKGAMTENADENALQSDAKGKLDSVATDYGAAIDGFIGDVSGLANGNGATGDFAGSNSQMAQVGDGDNSPLMNNFRQYLPSLPQSVECRPFVFGAGKPYEFSIDCDKINLFRGVFAFLLYVATFMYVFSTFANILRNKES

SEQ ID NO: 2965 - protein, 219 aa, Artificial Sequence
  Description of Artificial Sequence: Synthetic polypeptide
AETVESCLAKPHIENSFTNVWKDDKTLDRYANYEGCLWNATGVVVCTGDETQCYGTWVPIGLAIPENEGGGSEGGGSEGGGSEGGGTKPPEYGDTPIPGYIYINPLDGTYPPGTEQNPANPNPSLEESHPLNTFMFQNNRFRNRQGALTVYTGTVTQGTDPVKTYYQYTPVSSKAMYDAYWNGKFRDCAFHSGFNEDLFVCEYQGQSSYLPQPPVNAPS

SEQ ID NO: 2966 - protein, 528 aa, Artificial Sequence
  Description of Artificial Sequence: Synthetic polypeptide
MYRMQLLSCIALSLALVTNSMATTDAECLSKPAFDGTLSNVWKEGDSRYANFENCIYELSGIGIGYDNDTSWNGHWTPVRAADGSGNGGDDNSSGGGSNGDSGNNSTPDTVTPGQTVNLPSDLSTLSIPANVVKSDSIGSQFSLYTNASCTMCSGYYLSNNADSIAIANITETVKADYNQPDMWFEQTDSDGNHVKILQNSYKAVSYNVESKQSDVNNPTYINYSYSVNVKQVSYDTSNVCIMNWETFQNKCDASRAVLITDTVTPSYSRNITIQSNINYQGSNGSGGSGGSGGSGAMVRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2967 - protein, 434 aa, Artificial Sequence; identical to SEQ ID NO: 2949
  Description of Artificial Sequence: Synthetic polypeptide

SEQ ID NO: 2968 - protein, 434 aa, Artificial Sequence
  Description of Artificial Sequence: Synthetic polypeptide
MKRKIIAISLFLYIPLSNADNWESITKSYYTGFAISKTVESKDKDGKPVRKEVITQADLTTACNDAKASAQNVFNQIKLTLSGTWNDSQFRLVTGDTCVYNGSPGEKTESWSIRAQVEGDIQRSVPDEEPSEQTPEEICEAKPPIDGVFNNVFKGDEGGFYINYNGCEYEATGVTVCQNDGTVCSSSAWKPTGYVPESGEPSSSPLKDGDTGGTGEGGSDTGGDTGGGDTGGGSTGGDTGGSSGGGSSGGGSTGGSTGKSLTKEDVTAAIHVASPSIGDAVKDSLTEDNDQYDNQKKADEQSAKASASVSDAISDGMRGVGNFVDDFGGESSQYGTGNSEMDLSVSLAKGQLGIDREGHGSAWESFLNDGALRPSIPTGHGCTNFVMYQGSVYQIEIGCDKLNDIKSVLSWVMYCLTFWYVFQSVTSLLRKGEQ

SEQ ID NO: 2969 - protein, 460 aa, Artificial Sequence
  Description of Artificial Sequence: Synthetic polypeptide
MKKIIIALFFAPFFTHATTDAECLSKPAFDGTLSNVWKEGDSRYANFENCIYELSGIGIGYDNDTSCNGHWTPVRAADGSGNGGDDNSSGGGSNGDSGNNSTPDTVTPGQTVNLPSDLSTLSIPANVVKSDSIGSQFSLYTNASCTMCSGYYLSNNADSIAIANITETVKADYNQPDMWFEQTDSDGNHVKILQNSYKAVSYNVESKQSDVNNPTYINYSYSVNVKQVSYDTSNVCIMNWETFQNKCDASRAVLITDTVTPSYSRNITIQSNINYQGSNGSGGSGGSGGSGNDGGGTGNNGNGTGDFDYVKMANANKDALTESFDLSALQADTGASLDGSVQGTLDSLSGFSDSIGGLVGNGSAISGEFAGSSAAMNAIGEGDKSPLLDSLSFLKDGLFPALPEFKQCTPFVFAPGKEYEFIIECKYIDMFKGIFAFILYFWTFVTVYDSFSGILRKGRG

SEQ ID NO: 2970 - protein, 506 aa, Artificial Sequence
  Description of Artificial Sequence: Synthetic polypeptide
MYRMQLLSCIALSLALVTNSMAETVESCLAKPHTENSFTNVWKDDKTLDRYANYEGCLWNATGVVVCTGDETQCYGTWVPIGLAIPENEGGGSEGGGSEGGGSEGGGTKPPEYGDTPIPGYTYINPLDGTYPPGTEQNPANPNPSLEESQPLNTFMFQNNRFRNRQGALTVYTGTVTQGTDPVKTYYQYTPVSSKAMYDAYWNGKFRDCAFHSGFNEDPFVCEYQGQSSDLPQPPVNAGGGSGGGSGGGSEGGGSEGGGSEGGGSEGGGSGGGSGSGAMVRSPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 2971 - protein, 115 aa, Artificial Sequence
  Description of Artificial Sequence: Synthetic polypeptide
QVQLVQSGAELKKPGSSVKVSCKASGYTFTNYWMNWVRQAPGQGLEWIGATNPNNGYTDYNQRFKDRATLTADKSTNTAYMELSSLRSEDTAVYYCARGGHLAYWGQGTLVTVSS

SEQ ID NO: 2972 - protein, 115 aa, Artificial Sequence
  Description of Artificial Sequence: Synthetic polypeptide
QVQLVQSGAELKKPGSSVKVSCKASGYTFTNYWMNWVRQAPGQGLEWIGATNPNNGYTDYNQRFKDRVTITADKSTNTAYMELSSLRSEDTAVYYCARGGHLAYWGQGTLVTVSS

SEQ ID NO: 2973 - protein, 115 aa, Artificial Sequence
  Description of Artificial Sequence: Synthetic polypeptide
QVQLVQSGAELKKPGSSVKVSCKASGYTFTNYWMNWVRQAPGQGLEWIGATNPNNGYTDYNQRFKDRATLTADKSTNTAYMELSSLRSEDTAVYFCASGGHLAYWGQGTLVTVSS

SEQ ID NO: 2974 - protein, 115 aa, Artificial Sequence
  Description of Artificial Sequence: Synthetic polypeptide
QVQLVQSGAELKKPGSSVKVSCKASGYTFTNYWMNWVRQAPGQGLEWIGATNPNNGYTDYNQRFKDRATLTADKSTNTAYMELSSLRSEDTAVYYCASGGHLAYWGQGTLVTVSS

SEQ ID NO: 2975 - protein, 115 aa, Artificial Sequence
  Description of Artificial Sequence: Synthetic polypeptide
QVQLVQSGAELKKPGSSVKVSCKASGYTFTNYWMNWVRQAPGQGLEWIGATNPNNGYTDYNQRFKDRVTITADKSTNTAYMELSSLRSEDTAVYYCASGGHLAYWGQGTLVTVSS

SEQ ID NO: 2976 - protein, 128 aa, Artificial Sequence
  Description of Artificial Sequence: Synthetic polypeptide
MERHWIFLFLLSVTGGVHSQVQLQQSGAELAKPGTSVQMSCKASGYTFTNYWMNWIKARPGQGLEWIGATNPNNGYTDYNQRFKDKAILTADKSSNTAYMHLSSLTSEDSAVYFCASGGHLAYWGQGT

SEQ ID NO: 2977 - protein, 451 aa, Artificial Sequence
  Description of Artificial Sequence: Synthetic polypeptide
QSVEESGGRLVTPGTPLTLTCTVSGFSLSSYAMSWVRQAPGEGLEWIGIISDSGSTYYASWAKGRFTISKTSTTVDLRITSPTTEDTATYFCAREPEYGYDDYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2978 - protein, 451 aa, Artificial Sequence
  Description of Artificial Sequence: Synthetic polypeptide
QSVEESGGRLVTPGTPLTLTCTVSGFSLNSYAMSWVRQAPGEGLEWIGIISDSGRTYYASWAKGRFTISKTSTTVDLKITSPTTEDTATYFCAREPEYGYDDYGDWVSDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2979 - protein, 440 aa, Artificial Sequence
  Description of Artificial Sequence: Synthetic polypeptide
QSVEESGGRLVTPGTPLTLTCTVSGFSLSSADMIWVRQAPGKGLESIGMIYDDGDTYYATWAKGRFTISKTSTTVDLKIISPTTEDTATYFCVKGVSSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2980 - protein, 440 aa, Artificial Sequence
  Description of Artificial Sequence: Synthetic polypeptide
QSLEESGGRLVTPGTSLTLTCTASGFSLSAYDILWVRQAPGKGLESIGMMYDDGDTYYATWAKGRFIISRTSTTMDLKIISPTTEDTATYFCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2981 - protein, 440 aa, Artificial Sequence
  Description of Artificial Sequence: Synthetic polypeptide
QSVEESGGRLVTPGTPLTLTCTVSGSSLSDYDMIWVRQAPGKGLESIGIIYDDGDTYYATWAKGRFTISKTSTTVDLRIISPTTEDTATYFCVKGVSNMWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2982 - protein, 440 aa, Artificial Sequence
  Description of Artificial Sequence: Synthetic polypeptide
QSVEESGGRLVTPGTPLTLTCTVSGFSLSKYDMIWVRQAPGKGLESIGIIYDDGDTYYASWAKGRFTISQTSTTVDLKIISPTTEDTATYFCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2983 - protein, 443 aa, Artificial Sequence
  Description of Artificial Sequence: Synthetic polypeptide
EVQLVESGGGLVQPGGSLRLSCAASGFTVSNYDMIWVRQAPGKGLESIGMIYDDGDTYYASSAKGRFTISRDNSKNTLYLQMNSLRAEDTAVYYCVKGVSNHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2984 - protein, 443 aa, Artificial Sequence
  Description of Artificial Sequence: Synthetic polypeptide
EVQLVESGGGLVQPGGSLRLSCAASGFTVSKYDMIWVRQAPGKGLESIGIIYDDGDTYYASSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2985 - protein, 443 aa, Artificial Sequence
  Description of Artificial Sequence: Synthetic polypeptide
EVQLVESGGGLVQPGGSLRLSCAASGSSLSNFDMIWVRQAPGKGLESIGIIYDFGSTYYASSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2986 - protein, 443 aa, Artificial Sequence
  Description of Artificial Sequence: Synthetic polypeptide
EVQLVESGGGLVQPGGSLRLSCAASGFTVSKHDMIWVRQAPGKGLESIGIIYDDGDTYYANSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2987 - protein, 454 aa, Artificial Sequence
  Description of Artificial Sequence: Synthetic polypeptide
EVQLVESGGGLVQPGGSLRLSCAASGFSLTDYAMSWVRQAPGKGLEWIGIISDSGSTYYASSAKGRFTISRDNSKNTLYLQMNSLRAEDTAVYYCAREPEYGYDEYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2988 - protein, 454 aa, Artificial Sequence
  Description of Artificial Sequence: Synthetic polypeptide
EVQLVESGGGLVQPGGSLRLSCAASGFSLSSYAMSWVRQAPGKGLEWIGIISDSGSTYYASSAKGRFTISRDNSKNTLYLQMNSLRAEDTAVYYCAREPEYGYDDYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2989 - protein, 454 aa, Artificial Sequence; identical to SEQ ID NO: 2988
  Description of Artificial Sequence: Synthetic polypeptide

SEQ ID NO: 2990 - protein, 443 aa, Artificial Sequence
  Description of Artificial Sequence: Synthetic polypeptide
EVQLVESGGGLVQPGGSLRLSCAASGFTVSSADMIWVRQAPGKGLESIGMIYDDGDTYYATSAKGRFTISRDNSKNTLYLQMNSLRAEDTAVYYCVKGVSSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2991 - protein, 443 aa, Artificial Sequence
  Description of Artificial Sequence: Synthetic polypeptide
EVQLVESGGGLVQPGGSLRLSCAASGFTVSAYDILWVRQAPGKGLESIGMMYDDGDTYYATSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2992 - protein, 443 aa, Artificial Sequence
  Description of Artificial Sequence: Synthetic polypeptide
EVQLVESGGGLVQPGGSLRLSCAASGFTVSAYDILWVRQAPGKGLESIGMMYDDGDTYYATSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2993 - protein, 441 aa, Artificial Sequence
  Description of Artificial Sequence: Synthetic polypeptide
QSLEESGGRLVTPGTPLTLTCTVSGSSLSNFDMIWVRQAPGKGLESIGIIYDFGSTYYASWAKGRFTISRTSSTTVDLKIISPTIEDTATYFCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2994 - protein, 443 aa, Artificial Sequence
  Description of Artificial Sequence: Synthetic polypeptide
EVQLVESGGGLVQPGGSLRLSCAASGSSLSDYDMIWVRQAPGKGLESIGIIYDDGDTYYATSAKGRFTISRDNSKNTLYLQMNSLRAEDTAVYYCVKGVSNMWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2995 - protein, 440 aa, Artificial Sequence
  Description of Artificial Sequence: Synthetic polypeptide
QSVEESGGRLVTPGTPLTLTYTVSGFSLSKHDMIWVRQAPGKGLESIGIIYDDGDTYYANWAKGRFTISKTSTTVDLKIISPTTEDTATYFCVKGVSNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2996 - protein, 451 aa, Artificial Sequence
  Description of Artificial Sequence: Synthetic polypeptide
QSVEESGGRLVTPGTPLTLTCTVSGFSLSSYAMSWVRQAPGEGLEWIGIISDSGSTYYASWAKGRFTISKTSTTVDLKITSPTTEDTATYFCAREPEYGYDDYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2997 - protein, 451 aa, Artificial Sequence
  Description of Artificial Sequence: Synthetic polypeptide
QSVEESGGRLVTPGTPLTLTCTVSGFSLTDYAMSWVRQAPGEGLEWIGIISDSGSTYYASWAKGRFTFSKTSTTVDLRITSPTTEDTATYFCAREPEYGYDEYGDWVSDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2998 - protein, 440 aa, Artificial Sequence
  Description of Artificial Sequence: Synthetic polypeptide
QSVKESGGRLVTPGTPLTLTCTVSGFSLSNYDMIWVRQAPGKGLESIGMIYDDGDTYYASWAKGRFTISKTSTTVDLKIISPTTEDTATYFCVKGVSNHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2999 - protein, 117 aa, Artificial Sequence
  Description of Artificial Sequence: Synthetic polypeptide
QVQLVQSGAELKKPGASVKVSCKASGYSFTSYYIHWVKQAPGQGLEWIGWIYPGSGNTKYSEKFKGRATLTADTSTSTAYMELRSLRSDDTAVYFCARDGCYGFAYWGQGTLVTVSS

SEQ ID NO: 3000 - protein, 117 aa, Artificial Sequence
  Description of Artificial Sequence: Synthetic polypeptide
QVQLVQSGAEVKKPGASVKVSCKASGYSFTSYYIHWVRQAPGQGLEWIGWIYPGSGNTKYSEKFKGRATLTADTSTSTAYMELRSLRSDDTAVYFCARDGCYGFAYWGQGTLVTVSS

SEQ ID NO: 3001 - protein, 117 aa, Artificial Sequence
  Description of Artificial Sequence: Synthetic polypeptide
QVQLVQSGAEVKKPGASVKVSCKASGYTFTSYYIHWVRQAPGQGLEWMGWIYPGSGNTKYSEKFKGRATMTADTSTSTAYMELRSLRSDDTAVYYCARDGCYGFAYWGQGTLVTVSS

SEQ ID NO: 3002 - protein, 117 aa, Artificial Sequence
  Description of Artificial Sequence: Synthetic polypeptide
QVQLVQSGAEVKKPGASVKVSCKASGYSFTSYYIHWVRQAPGQGLEWIGWIYPGSGNTKYSEKFKGRATLTADTSTSTAYMELRSLRSDDTAVYFCARDGSYGFAYWGQGTLVTVSS

SEQ ID NO: 3003 - protein, 117 aa, Artificial Sequence
  Description of Artificial Sequence: Synthetic polypeptide
QVQLVQSGAEVKKPGASVKVSCKASGYTFTSYYIHWVRQAPGQGLEWMGWIYPGSGNTKYSEKFKGRATMTADTSTSTAYMELRSLRSDDTAVYYCARDGSYGFAYWGQGTLVTVSS

SEQ ID NO: 3004 - protein, 117 aa, Artificial Sequence
  Description of Artificial Sequence: Synthetic polypeptide
QVQLVQSGAEVKKPGASVKVSCKASGYSFTSYYIHWVRQAPGQGLEWMGWIYPGSGNTKYSEKFKGRVTMTTDTSTSTAYMELRSLRSDDTAVYYCARDGCYGFAYWGQGTLVTVSS

SEQ ID NO: 3005 - protein, 117 aa, Artificial Sequence
  Description of Artificial Sequence: Synthetic polypeptide
  MOD_RES (11)..(11): Any amino acid
  MOD_RES (28)..(28): Any amino acid
  MOD_RES (38)..(38): Any amino acid
  MOD_RES (48)..(48): Any amino acid
  MOD_RES (68)..(68): Any amino acid
  MOD_RES (70)..(70): Any amino acid
  MOD_RES (72)..(72): Any amino acid
  MOD_RES (95)..(95): Any amino acid
  MOD_RES (101)..(101): Any amino acid
QVQLVQSGAEXKKPGASVKVSCKASGYXFTSYYIHWVXQAPGQGLEWXGWIYPGSGNTKYSEKFKGRXTXTXDTSTSTAYMELRSLRSDDTAVYXCARDGXYGFAYWGQGTLVTVSS

SEQ ID NO: 3006 - protein, 115 aa, Artificial Sequence; identical to SEQ ID NO: 2972
  Description of Artificial Sequence: Synthetic polypeptide

SEQ ID NO: 3007 - protein, 115 aa, Artificial Sequence; identical to SEQ ID NO: 2975
  Description of Artificial Sequence: Synthetic polypeptide

SEQ ID NO: 3008 - protein, 117 aa, Artificial Sequence; identical to SEQ ID NO: 3005
  Description of Artificial Sequence: Synthetic polypeptide
  MOD_RES (11)..(11): Any amino acid
  MOD_RES (28)..(28): Any amino acid
  MOD_RES (38)..(38): Any amino acid
  MOD_RES (48)..(48): Any amino acid
  MOD_RES (68)..(68): Any amino acid
  MOD_RES (70)..(70): Any amino acid
  MOD_RES (72)..(72): Any amino acid
  MOD_RES (95)..(95): Any amino acid
  MOD_RES (101)..(101): Any amino acid

SEQ ID NO: 3009 - protein, 447 aa, Artificial Sequence
  Description of Artificial Sequence: Synthetic polypeptide
QVQLVQSGAEVKKPGASVKVSCKASGYTFTSYYIHWVRQAPGQGLEWMGWIYPGSGNTKYSEKFKGRATMTADTSTSTAYMELRSLRSDDTAVYYCARDGCYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNVKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3010 - protein, 447 aa, Artificial Sequence
  Description of Artificial Sequence: Synthetic polypeptide
QVQLVQSGAEVKKPGASVKVSCKASGYTFTSYYIHWVRQAPGQGLEWMGWIYPGSGNTKYSEKFKGRATMTADTSTSTAYMELRSLRSDDTAVYYCARDGCYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3011 - protein, 116 aa, Artificial Sequence
  Description of Artificial Sequence: Synthetic polypeptide
  MOD_RES (74)..(74): Any amino acid
  MOD_RES (97)..(97): Any amino acid
EVQLVESGGGLVQPGGSLRLSCAASGFTFSNYGMSWVRQAPGKGLEWVASISSGGGSTYYPDNVKGRFTISRDXAKNSLYLQMNSLRAEDTAVYYCXRGGAGIDYWGQGTLVTVSS

SEQ ID NO: 3012 - protein, 446 aa, Artificial Sequence
  Description of Artificial Sequence: Synthetic polypeptide
EVQLVESGGGLVQPGGSLRLSCAASGFTFSNYGMSWVRQAPGKGLEWVASISSGGGSTYYPDNVKGRFTISRDDAKNSLYLQMNSLRAEDTAVYYCARGGAGIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNVKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3013 - protein, 446 aa, Artificial Sequence; identical to SEQ ID NO: 3012
  Description of Artificial Sequence: Synthetic polypeptide

SEQ ID NO: 3014 - protein, 446 aa, Artificial Sequence
  Description of Artificial Sequence: Synthetic polypeptide
EVQLVESGGGLVQPGGSLRLSCAASGFTFSNYGMSWVRQAPGKGLEWVASISSGGGSTYYPDNVKGRFTISRDDAKNSLYLQMNSLRAEDTAVYYCARGGAGIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3015 - protein, 115 aa, Artificial Sequence; identical to SEQ ID NO: 2971
  Description of Artificial Sequence: Synthetic polypeptide

SEQ ID NO: 3016 - protein, 115 aa, Artificial Sequence; identical to SEQ ID NO: 2973
  Description of Artificial Sequence: Synthetic polypeptide

SEQ ID NO: 3017 - protein, 115 aa, Artificial Sequence; identical to SEQ ID NO: 2974
  Description of Artificial Sequence: Synthetic polypeptide

SEQ ID NO: 3018 - protein, 226 aa, Artificial Sequence
  Description of Artificial Sequence: Synthetic polypeptide
AAQPAMAQSVEESGGRLVTPGTPLTLTCTVSGFSLSAYEVSWVRQAPGKGLEWIGIIYANGNTVYASWAKGRFTISKTSTKVDLRIPSPTTEDTATYFCARDIYTTTTNLWGPGTLVTVSSGQPKAPSVFPLAPCCGDTHSSTVTLGCLVKGYLPEPVTVTWNSGTLTNGVRTFPSVRQSSGLYSLSSVVSVTSSSQPVTCNVAHPATNTKVDKTVAPSTCSKTSC

SEQ ID NO: 3019 - protein, 251 aa, Artificial Sequence
  Description of Artificial Sequence: Synthetic polypeptide
AAQPAMAQLVEESGGRLVTPGTPLTLTCTVSGFSLSSYAMSWVRQAPGKGLEWIGVISSSGNTYYASWAKGRFTISKTSTTVDLKMTSLTTEDTATYFCARGVVSGRIDTGLTLWGPGTLVTVSSVSLSSPTLYPLVSCEGALTDGNLVAMGCLARDFLPSSITFSWSFKNNSEISSRTVRTFPVVKRGDKYMATSQVLVPSKDVLQGTEEYLVCKVQHDNSNRDLRVSFPGEPRGLPRDGEVDSELPTSV

SEQ ID NO: 3020 - protein, 218 aa, Artificial Sequence
  Description of Artificial Sequence: Synthetic polypeptide
AQAAELVMTQTPSSVSAAVGGTVTISCQSSESVYNNNYLSWYQQKPGQPPKRLIDSASTLDSGVPSRFKGSGSGAQFTLTISDLECDDAATYYCAGAYVNWMRIFGGGTEVVVKGDPVAPTVLIFPPSADLVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 3021 - protein, 222 aa, Artificial Sequence
  Description of Artificial Sequence: Synthetic polypeptide
MAQSVEESGGRLVTPGTPLTLTCTASGFSLINYYMNWVRQAPGKGLEWIGLITGWADTYYANSAKGRFTISKTSSTTVDLKITSPTTDDTATYFCVRGGHTNIISLWGPGTLVTVSSGQPKAPSVFPLPPCCGDTPSSTVTLGCLVKGYLPEPVTVTWNSGTLTNGVRIFPSVRQSSGLYSLSSVVSVTSSSQPVTCNVAHPATNTKVDKTVAPSTCSKTSC

SEQ ID NO: 3022 - protein, 470 aa, Artificial Sequence
  Description of Artificial Sequence: Synthetic polypeptide
MKLWLNWIFLVTLLNGIQCEVKLVESGGGLVQPGGSLRLSCATSGFTFTDYYMSWVRQPPGKALEWLGFIRNKATGYTTEYSASVKGRFTISRDNSQSILYLQMNTLRAEDSATYYCARDFGSRWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3023 - protein, 467 aa, Artificial Sequence
  Description of Artificial Sequence: Synthetic polypeptide
MRVLILLWLFTAFPGILSDVQLQESGPGLVKPSQSLSLTCTVTGYSITSDYAWNWIRQFPGNKLEWMGYISYSGSTIYNPSLKSRISITRDTSKNQFFLQLNSVTTEDTATYYCARFGNYGNTLNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3024 - protein, 470 aa, Artificial Sequence
  Description of Artificial Sequence: Synthetic polypeptide
MKLWLNWIFLVTLLNGIQCEVQLVESGGGLVQPGGSLRLSCAASGFTFTDYYMSWVRQAPGKGLEWVGFIRNKATGYTTEYSASVKGRFTISRDDSKNSLYLQMNSLKTEDTAVYYCARDFGSRWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3025 - protein, 671 aa, Artificial Sequence
  Description of Artificial Sequence: Synthetic polypeptide
MRVLILLWLFTAFPGILSDVQLQESGPGLVKPSETLSLTCTVSGYSITSDYAWNWIRQPPGKGLEWIGYISYSGSTIYNPSLKSRVTISVDTSKNQFSLKLSSVTAADTAVYYCARFGNYGNTLNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVMDSQAQVLILLLLWVSGTCGDIVMTQSPLSLPVTPGEPASISCKSSQSLLNSRTRKNYLAWYLQKPGQSPQLLIYWASTRESGVPDRFSGSGSGTDFTLKISRVEAEDVGVYYCKQSYDLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3026 - protein, 470 aa, Artificial Sequence
  Description of Artificial Sequence: Synthetic polypeptide
MKLWLNWIFLVTLLNGIQCEVQLLESGGGLVQPGGSLRLSCAASGFTFTDYYMSWVRQAPGKGLEWVSFIRNKATGYTTEYSASVKGRFTISRDNSKNTLYLQMNSLRAEDTAVYYCAKDFGSRWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3027 - protein, 454 aa, Artificial Sequence
  Description of Artificial Sequence: Synthetic polypeptide
MKLWLNWIFLVTLLNGIQCQVTLKESGPVLVKPTETLTLTCTVSGFTFTDYYMSWIRQPPGKALEWLAFIRNKATGYTTEYSASVKGRLTISKDTSKSQVVLTMTNMDPVDTATYYCARDFGSRWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3028 - protein, 467 aa, Artificial Sequence
  Description of Artificial Sequence: Synthetic polypeptide
MRVLILLWLFTAFPGILSQVQLVQSGAEVKKPGASVKVSCKASGYSITSDYAWNWVRQAPGQRLEWMGYISYSGSTIYNPSLKSRVTITRDTSASTAYMELSSLRSEDMAVYYCARFGNYGNTLNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3029 - protein, 431 aa, Artificial Sequence
  Description of Artificial Sequence: Synthetic polypeptide
MRVLILLWLFTAFPGILSDVQLQESGPGLVKPSQSLSLTCTVTGYSITSDYAWNWIRQFPGNKLEWMGYISYSGSTIYNPSLKSRISITRDTSKNQFFLQLNSVTTEDTATYYCARFGNYGNTLNYWGQGTSVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFI

SEQ ID NO: 3030 - protein, 476 aa, Artificial Sequence
  Description of Artificial Sequence: Synthetic polypeptide
MKLWLNWIFLVTLLNGIQCEVKLVESGGGLVQPGGSLRLSCATSGFTFTDYYMSWVRQPPGKALEWLGFIRNKATGYTTEYSASVKGRFTISRDNSQSILYLQMNTLRAEDSATYYCARDFGSRWYFDVWGAGTTVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 3031 - protein, 462 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWIGNINPSNGGTNYNEKFKSRATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3032 - protein, 462 aa, Artificial Sequence
  Description of Artificial Sequence: Synthetic polypeptide
MGWSCIILFLVATATGVHSQVQLVQSGAEVKKPGASVKVSCKASGYTFTSYWMHWVKQRPGQGLEWIGNINPSNGGTNYNEKFKSKATLTVDKSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3033 - protein, 462 aa, Artificial Sequence
  Description of Artificial Sequence: Synthetic polypeptide
MGWSCIILFLVATATGVHSQVQLVQSGAEVVKPGASVKLSCKASGYTFTSYWMHWVKQRPGQGLEWIGNINPSNGGTNYNEKFKSKATLTVDKSSSTAYMELSSLRSEDSAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3034 - protein, 462 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQRPGQGLEWIGNINPSNGGTNYNEKFKSRATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3035 - protein, 462 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWIGNINPSNGGTNYNEKFKSKATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3036 - protein, 462 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQRPGQGLEWIGNINPSNGGTNYNEKFKSKATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3037 - protein, 462 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQRPGQGLEWMGNINPSNGGTNYNEKFKSRVTMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3038 - protein, 144 aa, Artificial Sequence
  Description of Artificial Sequence: Synthetic polypeptide
MKLPVRLLVLMFWIPASSSDVVMTQTPLSLPVSLGDQASISCRSSQSLVHSNGYTYLHWYLQRPGQSPKLLIYKVSNRFSGVPDRFSGSGSGTDFTLKISRVDAEDLGVYFCSQSTHVPYTFGGGTKLEIKRADAAPTVSISHH

SEQ ID NO: 3039 - protein, 114 aa, Artificial Sequence
  Description of Artificial Sequence: Synthetic polypeptide
  MOD_RES (3)..(3): Any amino acid
LQXSGAEIVMPGTAVTMSCKASGYTFTDFWMHWVKQRPGQGLEWIGAIDPSDSYSRINQKFKGKATLTVDESSSTAYMQLSSLTSEDSAVYYCARRITEAGAWFAYWGQGTTVT

SEQ ID NO: 3040 - protein, 122 aa, Artificial Sequence
  Description of Artificial Sequence: Synthetic polypeptide
NQVQLQQSGAELMQPGASVKISCKSTGYTFSNFWIEWVKQRPGHGLEWIGEILPGSDNTNYNEKFKGKATFTADTSSNTAYMQLSSLTSEDSAVYYCARKNRNYYGNYVVWGQGTLVTVSAC

SEQ ID NO: 3041 - protein, 122 aa, Artificial Sequence
  Description of Artificial Sequence: Synthetic polypeptide
NQVQLQQSGAELMQPGASVKISCKSTGYTFSNFWIEWVKQRPGHGLEWIGEILPGSDNTNYNEKFKGKATFTADTSSNTAYMQLSSLTSEDSAVYYCARKNRNYYGNYVVWGAGTTLTVSSC

SEQ ID NO: 3042 - protein, 126 aa, Artificial Sequence
  Description of Artificial Sequence: Synthetic polypeptide
NQVQLQQPGAELVKPGASVKLSCKASGYTFTSYWMHWVKQRPGQGLEWIGEIYPSNGRTNYNEKFKSKATLTVDKSSSTAYMQLSSLTSEDSAVYYCARKYYYGNSYRSWYFDVWGAGTTLTVSSC

SEQ ID NO: 3043 - protein, 130 aa, Artificial Sequence
  Description of Artificial Sequence: Synthetic polypeptide
NQVQLQESGPGLVKPSQTLSLTCTVSGGSISSGGYYWSWIRQHPGKGLEWIGYIYYSGSTNYNPSLKSRVTISVDTSKNQFSLKLSSVTAADTAVYYCTRDRDYDSTGDYYSYYGMDVWGQGTTVTVSSC

SEQ ID NO: 3044 - protein, 119 aa, Artificial Sequence
  Description of Artificial Sequence: Synthetic polypeptide
NQVQLQESGPGLVRPSETLSLTCTVSGGSISTYYWNWIRQPAGKGLEWIGRIYTSGSTNYNPSLKSRVTMSVDTSKNQFSLKLSSVTAADTAVYYCARDGGYSNPFDWGQGTLVTVSSC

SEQ ID NO: 3045 - protein, 129 aa, Artificial Sequence
  Description of Artificial Sequence: Synthetic polypeptide
NQVQLQESGPGLVKPSQTLSLTCTVSGGSISSGGYYWSWIRQHPEKGLEWIGYIFYSGRTYYNPSLKSRVTISVDTSKNQFSLKLNSVTAADTAVYYCARERIAAAGADYYYNGLDVWGQGTTVTVSSC

SEQ ID NO: 3046 - protein, 129 aa, Artificial Sequence
  Description of Artificial Sequence: Synthetic polypeptide
NQVQLQESGPGLVKPSQTLSLTCTVSGGSISSGYYYWSWIRQHPGKGLEWIGYIYYSGSTYYNPSLKSRLTISVDTSKNQFSLKLSSVTAADTAVYYCARERIAAAGTDYYYNGLAVWGQGTTVTVSSC

SEQ ID NO: 3047 - protein, 116 aa, Artificial Sequence; identical to SEQ ID NO: 3011
  Description of Artificial Sequence: Synthetic polypeptide
  MOD_RES (74)..(74): Any amino acid
  MOD_RES (97)..(97): Any amino acid

SEQ ID NO: 3048 - protein, 116 aa, Artificial Sequence
  Description of Artificial Sequence: Synthetic polypeptide
EVKLVESGGGLVKPGASLKLSCAASGFTFSNYGMSWVRQTSDKRLEWVASISSGGGSTYYPDNVKGRFTISREDAKNTLYLQMSSLRSEDTALYYCSRGGAGIDYWGQGTTLTVSS

SEQ ID NO: 3049 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3050 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3051 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3052 - protein, 330 aa, Artificial Sequence; identical to SEQ ID NO: 3050
  Description of Artificial Sequence: Synthetic polypeptide

SEQ ID NO: 3053 - protein, 330 aa, Artificial Sequence; identical to SEQ ID NO: 3051
  Description of Artificial Sequence: Synthetic polypeptide

SEQ ID NO: 3054 - protein, 330 aa, Artificial Sequence; identical to SEQ ID NO: 2950
  Description of Artificial Sequence: Synthetic polypeptide

SEQ ID NO: 3055 - protein, 326 aa, Artificial Sequence; identical to SEQ ID NO: 3049
  Description of Artificial Sequence: Synthetic polypeptide

SEQ ID NO: 3056 - protein, 582 aa, Artificial Sequence [sequence omitted]

SEQ ID NO: 3057 - protein, 582 aa, Artificial Sequence [sequence omitted]

SEQ ID NO: 3058 - protein, 582 aa, Artificial Sequence [sequence omitted]

SEQ ID NO: 3059 - protein, 582 aa, Artificial Sequence
  Description of Artificial Sequence: Synthetic polypeptide
MECSWVMLFLLSGTAGVHCQVQLQQSGPELVKPGALVKISCKASGYTFTNYDIHWVKQRPGQGLEWIGWIYPGDGSTKYNEKFKGKATLTADKSSSTAYMHLSSLTSEKSAVYFCAREWAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVRVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSSMHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKR

SEQ ID NO: 3060 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWMGNINPSNGGTNYNEKFKSRVTMTRDTSTSTVYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3061 - protein, 458 aa, Artificial Sequence
  Description of Artificial Sequence: Synthetic polypeptide
MGWSCIILFLVATATGVHSQVQLVQSGAEWKPGASVKLSCKASGYTFTSYWMHWVKQAPGQGLEWIGNINPSNGGTNYNEKFKSRATLTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3062 - protein, 459 aa, Artificial Sequence
  Description of Artificial Sequence: Synthetic polypeptide
MGWSCIILFLVATATGVHSQVQLVQSGAEWKPGASVKLSCKASGYTFTSYWMHWVKQRPGQGLEWIGNINPSNGGTNYNEKFKSKATLTVDTSSSTAYMELSSLRSEDSAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3063 - protein, 459 aa, Artificial Sequence
  Description of Artificial Sequence: Synthetic polypeptide
MGWSCIILFLVATATGVHSQVQLVQSGAEVKKPGASVKVSCKASGYTFTSYWMHWVKQRPGQGLEWIGNINPSNGGTNYNEKFKSKATLTVDKSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3064 - protein, 458 aa, Artificial Sequence
  Description of Artificial Sequence: Synthetic polypeptide
MGWSCIILFLVATATGVHSQVQLVQSGAEWKPGASVKLSCKASGYTFTSYWMHWVKQRPGQGLEWIGNINPSNGGTNYNEKFKSKATLTVDKSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3065 - protein, 458 aa, Artificial Sequence
  Description of Artificial Sequence: Synthetic polypeptide
MGWSCIILFLVATATGVHSQVQLVQSGAEWKPGASVKLSCKASGYTFTSYWMHWVKQRPGQGLEWIGNINPSNGGTNYNEKFKSKATLTVDKSSSTAYMELSSLRSEDSAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3066 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQRPGQGLEWIGNINPSNGGTNYNEKFKSRATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3067 - protein, 459 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWIGNINPSNGGTNYNEKFKSKATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3068 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQRPGQGLEWIGNINPSNGGTNYNEKFKSKATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3069 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVKQRPGQGLEWIGNINPSNGGTNYNEKFKSKATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3070 - protein, 459 aa, Artificial Sequence
  Description of Artificial Sequence: Synthetic polypeptide
MGWSCIILFLVATATGVHSQVQLVQSGAEVKKPGASVKVSCKASGYTFTSYWMHWVKQRPGQGLEWIGNINPSNGGTNYNEKFKSKATMTVDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3071 - protein, 459 aa, Artificial Sequence
  Description of Artificial Sequence: Synthetic polypeptide
MGWSCIILFLVATATGVHSQVQLVQSGAEVKKPGASVKVSCKASGYTFTSYWMHWVKQRPGQGLEWIGNINPSNGGTNYNEKFKSKATLTVDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3072 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQRPGQGLEWMGNINPSNGGTNYNEKFKSRVTMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3073 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWMGNINPSNGGTNYNEKFKSRVTMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3074 - protein, 460 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWIGNINPSNGGTNYNEKFKSRATMTRDTSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3075 - protein, 459 aa, Artificial Sequence
  Description of Artificial Sequence: Synthetic polypeptide
MGWSCIILFLVATATGVHSQVQLVQSGAEVKKPGASVKVSCKASGYTFTSYWMHWVRQAPGQGLEWIGNINPSNGGTNYNEKFKSRATLTVDKSTSTAYMELSSLRSEDTAVYYCELGQGYWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELAGAPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3076 - protein, 441 aa, Artificial Sequence
  Description of Artificial Sequence: Synthetic polypeptide
EVQLVESGGGLVQPGGSLRLSCAASGFTFSNYWMSWVRQAPGKGLEWVATIKQDGSQKNYVDSVKGRFTISRDNAKNSLYLRLNSLRAEDTAVYYCATELFDLWGRGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3077 - protein, 113 aa, Artificial Sequence
  Description of Artificial Sequence: Synthetic polypeptide
EVQLVESGGGLVEPGGSLRLSCAVSGFDFEKAWMSWVRQAPGQGLQWVARIKSTADGGTTSYAAPVEGRFIISRDDSRNMLYLQMNSLKTEDTAVYYCTSAHWGQGTLVTVSS

SEQ ID NO: 3078 - protein, 123 aa, Artificial Sequence
  Description of Artificial Sequence: Synthetic polypeptide
EVQLVESGGGVVQPGRSLRLSCAASGFTFSTYAISWVRQAPGKGLEWVAIISNDGSRKYYADSVKGRFTISRDNSRDTLDLEMNSLRDEDTAVYYCAKKRGTYASRCKAFDFWGQGTLVTVSS

SEQ ID NO: 3079 - protein, 123 aa, Artificial Sequence
  Description of Artificial Sequence: Synthetic polypeptide
QVQLVESGGGVVQPGRSLRLSCAASGFTFSTYAISWVRQAPGKGLEWVAIISNDGSRKYYADSVKGRFTISRDNSRDTLDLEMNSLRDEDTAVYYCAKKRGTYASRCKAFDFWGQGTLVTVSS

SEQ ID NO: 3080 - protein, 121 aa, Artificial Sequence
  Description of Artificial Sequence: Synthetic polypeptide
EVQLVQSGAEVKKPGASVRLSCRASGYNFIDFHIHWVRQAPGEGLEWMGWSNPQSGNSSSAQRFQGRVTMTTDTSMSAAYMDLNWLTLDDTAVYYCTRPHDGAGNYRFDTWGQGTLVTVSS

SEQ ID NO: 3081 - protein, 121 aa, Artificial Sequence
  Description of Artificial Sequence: Synthetic polypeptide
QVQLVQSGAEVKKPGASVRLSCRASGYNFIDFHIHWVRQAPGEGLEWMGWSNPQSGNSSSAQRFQGRVTMTTDTSMSAAYMDLNWLTLDDTAVYYCTRPHDGAGNYRFDTWGQGTLVTVSS

SEQ ID NO: 3082 - protein, 113 aa, Artificial Sequence
  Description of Artificial Sequence: Synthetic polypeptide
EVQLVQSGGGLVEPGGSLRLSCAVSGFDFEKAWMSWVRQAPGQGLQWVARIKSTADGGTTSYAAPVEGRFIISRDDSRNMLYLQMNSLKTEDTAVYYCTSAHWGQGTLVTVSS

SEQ ID NO: 3083 - protein, 116 aa, Artificial Sequence
  Description of Artificial Sequence: Synthetic polypeptide
EVQLVESGGGLVQPGGSLRLSCAASGFTFSNYGMSWVRQAPGKGLEWVASISSGGGSTYYPDNVKGRFTISRDDAKNSLYLQMNSLRAEDTAVYYCARGGAGIDYWGQGTLVTVSS

SEQ ID NO: 3084 - protein, 116 aa, Artificial Sequence
  Description of Artificial Sequence: Synthetic polypeptide
EVQLVESGGGLVQPGGSLRLSCAASGFTFSNYGMSWVRQAPGKGLEWVASISSGGGSTYYPDNVKGRFTISRDNAKNSLYLQMNSLRAEDTAVYYCARGGAGIDYWGQGTLVTVSS

SEQ ID NO: 3085 - protein, 113 aa, Artificial Sequence
  Description of Artificial Sequence: Synthetic polypeptide
DIQMTQSPSSLSASVGDRVTITCKSIQTLLYSSNQKNYLAWFQQKPGKAPKLLIYWASIRKSGVPSRFSGSGSGTDFTLTISSLQPEDLATYYCQQYYSYPLTFGGGTKLEIK

SEQ ID NO: 3086 - protein, 116 aa, Artificial Sequence; identical to SEQ ID NO: 3048
  Description of Artificial Sequence: Synthetic polypeptide

SEQ ID NO: 3087 - protein, 116 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGSSDMDYWGQGTLVTVSS

SEQ ID NO: 3088 - protein, 116 aa, Artificial Sequence
  Description of Artificial Sequence: Synthetic polypeptide
EVQLVESGGGLVQPGGSLRLSCAASGFTFSNYGMSWVRQAPGKGLEWVASISSGGGSTYYPDNVKGRFTISRDDAKNSLYLQMNSLRAEDTAVYYCSRGGAGIDYWGQGTLVTVSS

SEQ ID NO: 3089 - protein, 116 aa, Artificial Sequence
  Description of Artificial Sequence: Synthetic polypeptide
EVQLVESGGGLVQPGGSLRLSCAASGFTFSNYGMSWVRQAPGKGLEWVASISSGGGSTYYPDNVKGRFTISRDNAKNSLYLQMNSLRAEDTAVYYCSRGGAGIDYWGQGTLVTVSS

SEQ ID NO: 3090 - protein, 135 aa, Artificial Sequence
  Description of Artificial Sequence: Synthetic polypeptide
MGWSWVFIFLLSGTAGVHCQVQLQQSGPELVKPGTSVKISCKASGYSFTSYYIHWVKQSPGQGLEWIGWIYPGSGNTKYSEKFKGKATLTADTSSSTAYMQLSSLTSEDSAVYFCARDGCYGFAYWGQGTLVTVS

SEQ ID NO: 3091 - protein, 115 aa, Artificial Sequence
  Description of Artificial Sequence: Synthetic polypeptide
VQLQQSGPELVKPGTSVKISCKASGYSFTSYYIHWVKQSPGQGLEWIGWIYPGSGNTKYSEKFKGKATLTADTSSSTAYMQLSSLTSEDSAVYFCARDGCYGFAYWGQGTLVTVS

SEQ ID NO: 3092 - protein, 116 aa, Artificial Sequence; identical to SEQ ID NO: 3083
  Description of Artificial Sequence: Synthetic polypeptide

SEQ ID NO: 3093 - protein, 116 aa, Artificial Sequence
  Description of Artificial Sequence: Synthetic polypeptide
VQLVQSGAEVKKPGASVKVSCKASGYSFTSYYIHWVRQAPGQGLEWIGWIYPGSGNTKYSEKFKGRATLTADTSTSTAYMELRSLRSDDTAVYFCARDGSYGFAYWGQGTLVTVSS

SEQ ID NO: 3094 - protein, 116 aa, Artificial Sequence; identical to SEQ ID NO: 3084
  Description of Artificial Sequence: Synthetic polypeptide

SEQ ID NO: 3095 - protein, 117 aa, Artificial Sequence; identical to SEQ ID NO: 3003
  Description of Artificial Sequence: Synthetic polypeptide

SEQ ID NO: 3096 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 3097 - protein, 115 aa, Artificial Sequence
  Description of Artificial Sequence: Synthetic polypeptide
QVQLQQSGAELAKPGTSVQMSCKASGYTFTNYWMNWIKARPGQGLEWIGATNPNNGYTDYNQRFKDKAILTADKSSNTAYMHLSSLTSEDSAVYFCASGGHLAYWGQGTVVTVSA

SEQ ID NO: 3098 - protein, 116 aa, Artificial Sequence; identical to SEQ ID NO: 3087
  Description of Artificial Sequence: Synthetic polypeptide

SEQ ID NO: 3099 - protein, 116 aa, Artificial Sequence; identical to SEQ ID NO: 3088
  Description of Artificial Sequence: Synthetic polypeptide

SEQ ID NO: 3100 - protein, 135 aa, Artificial Sequence; identical to SEQ ID NO: 3090
  Description of Artificial Sequence: Synthetic polypeptide

SEQ ID NO: 3101 - protein, 115 aa, Artificial Sequence; identical to SEQ ID NO: 3091
  Description of Artificial Sequence: Synthetic polypeptide

SEQ ID NO: 3102 - protein, 116 aa, Artificial Sequence; identical to SEQ ID NO: 3089
  Description of Artificial Sequence: Synthetic polypeptide

SEQ ID NO: 3103 - protein, 117 aa, Artificial Sequence; identical to SEQ ID NO: 2999
  Description of Artificial Sequence: Synthetic polypeptide

SEQ ID NO: 3104 - protein, 117 aa, Artificial Sequence; identical to SEQ ID NO: 3000
  Description of Artificial Sequence: Synthetic polypeptide

SEQ ID NO: 3105 - protein, 117 aa, Artificial Sequence; identical to SEQ ID NO: 3001
  Description of Artificial Sequence: Synthetic polypeptide

SEQ ID NO: 3106 - protein, 121 aa, Artificial Sequence
  Description of Artificial Sequence: Synthetic polypeptide
EVQLVETGGGLVQPKGSLKLSCATSGFTFNTYAMNWVRQAPGKGLEWVARIRTKSNDYATYYADSVKGRITISRDDSQSMLYLQMNNLKTEDTAMYYCVRVGYRPYAMDYWGQGTSVTVSS

SEQ ID NO: 3107 - protein, 119 aa, Artificial Sequence
  Description of Artificial Sequence: Synthetic polypeptide
EVQLVESGGDLVKPGGSLKFSCAASGFTFSNYAMSWRQTPDKRLEWATVTSGGSYTYYPDSVRGRFTISRDNAKNTLYLQLSSLKSEDTAMYFCARQNFGSRGWYFDVWGAGTTVTVSS

SEQ ID NO: 3108 - protein, 120 aa, Artificial Sequence
  Description of Artificial Sequence: Synthetic polypeptide
EVMLVESGGGLVKPGGSLKLSCAASGFTFSSYAMSWVRQTPEKRLEWVATISNGGSYTYYPDSVKGRFTISRDNAKNTLYLQMSSLRSEDTAMYYCARHSDYSGAWFAYWGQGTLVTVSA

SEQ ID NO: 3109 - protein, 120 aa, Artificial Sequence
  Description of Artificial Sequence: Synthetic polypeptide
EVQLQESGPSLVKPSQTLSLTCSVTGDSFTSGYWNWIRKFPGNKLEYMGYIRYSGNTYYNPSLKSRISITRDTSKNQYYLQLISVTTEDTATFYCARSYYDYDRAWFAYWGQGALVTVSA

SEQ ID NO: 3110 - protein, 120 aa, Artificial Sequence
  Description of Artificial Sequence: Synthetic polypeptide
EVQLQQSGPELVKPGASVKMSCKASGYTFTDYYMKWVKQSHGKSLEWIGDINPNNGDTFYNQKFKGKATLTVDKSSSTAYMQLNSLTSEDSAVYYCARGVYDGYYAMDYWGQGTSVTVSS

SEQ ID NO: 3111 - protein, 118 aa, Artificial Sequence
  Description of Artificial Sequence: Synthetic polypeptide
EVQLLESGGGLVQPGGSLRLSCAASGFTFSPYWMSWVRQAPGKGLEWVSVIYPSGGHTYYADSVKGRFTISRDNSKNTLYLQMNSLRAEDTAVYYCARPGFGAAFDYWGPGTLVTVSS

SEQ ID NO: 3112 - protein, 119 aa, Artificial Sequence
  Description of Artificial Sequence: Synthetic polypeptide
EVQLLESGGGLVQPGGSLRLSCAASGFTFSDYPMMWVRQAPGKGLEWVSRISPSGGHTIYADSVKGRFTISRDNSKNTLYLQMNSLRAEDTAVYYCAKDWHGGGAFDIWGQGTMVTVSS

SEQ ID NO: 3113 - protein, 128 aa, Artificial Sequence
  Description of Artificial Sequence: Synthetic polypeptide
EVQLLESGGGLVQPGGSLRLSCAASGFTFSRYSMQWVRQAPGKGLEWVSVISPSGGSTMYADSVKGRFTISRDNSKNTLYLQMNSLRAEDTAVYYCARESYSSSWYSGYYYYYGMDVWGQGTTVTVSS

SEQ ID NO: 3114 - protein, 116 aa, Artificial Sequence
  Description of Artificial Sequence: Synthetic polypeptide
EVQLLESGGGLVQPGGSLRLSCAASGFTFSQYMMSWVRQAPGKGLEWVSVIYPSGGSTHYADSVKGRFTISRDNSKNTLYLQMNSLRAEDTAVYYCARGHYGMDVWGQGTTVTVSS

SEQ ID NO: 3115 - protein, 120 aa, Artificial Sequence
  Description of Artificial Sequence: Synthetic polypeptide
EVQLLESGGGLVQPGGSLRLSCAASGFTFSPYAMVWVRQAPGKGLEWVSSISPSGGGTGYADSVKGRFTISRDNSKNTLYLQMNSLRAEDTAVYYCAREGWNYYYGMDVWGQGTTVTVSS

SEQ ID NO: 3116 - protein, 113 aa, Artificial Sequence
  Description of Artificial Sequence: Synthetic polypeptide
QVQLQQSGTELARPGASVKLSCKASGYTFTDYYLNWMKQGTGQGLEWIGEIYPGGDHTYYNEKFKGKATLTADKSSNTAFMQLSSLTSEDSAVYFCTRGVIKWGQGTLVTVSL

SEQ ID NO: 3117 - protein, 113 aa, Artificial Sequence
  Description of Artificial Sequence: Synthetic polypeptide
QVQLQQSGPEVARPGASVKLSCKASGYTFTDYYLNWVKQRTGQGLEWIGEIYPGNNHTYYNEKFKGKATLTADNSSSTAYLQFSSLTSEDSAVYFCTRGVIKWGQGTLVTVSV

SEQ ID NO: 3118 - protein, 122 aa, Artificial Sequence
  Description of Artificial Sequence: Synthetic polypeptide
EVQLVESGGGLVKPGGSLKLSCAASGFTFSDYYMYWVRQTPEKRLEWVATISDGGLYTYYQDSVKGRFTISRDNAKNNLYLQMSSLKSEDTAMYYCAREDDYDGDFYTMDYWGQGTSVTVSS

SEQ ID NO: 3119 - protein, 117 aa, Artificial Sequence
  Description of Artificial Sequence: Synthetic polypeptide
EVQLLESGGGLVQPGGSLRLSCAASGFTFSPYSMTWVRQAPGKGLEWVSSIVPSGGKTWYADSVKGRFTISRDNSKNTLYLQMNSLRAEDTAVYYCARTNLSYFDYWGQGTLVTVSS

SEQ ID NO: 3120 - protein, 115 aa, Artificial Sequence
  Description of Artificial Sequence: Synthetic polypeptide
EVQLLESGGGLVQPGGSLRLSCAASGFTFSNYEMSWVRQAPGKGLEWVSSIYSSGGETLYADSVKGRFTISRDNSKNTLYLQMNSLRAEDTAVYYCARDGAADYWGQGTLVTVSS

SEQ ID NO: 3121 - protein, 117 aa, Artificial Sequence
  Description of Artificial Sequence: Synthetic polypeptide
EVQLLESGGGLVQPGGSLRLSCAASGFTFSEYTMHWVRQAPGKGLEWVSVISSSGGRTVYADSVKGRFTISRDNSKNTLYLQMNSLRAEDTAVYYCARDLSNYMDYWGQGTLVTVSS

SEQ ID NO: 3122 - protein, 116 aa, Artificial Sequence
  Description of Artificial Sequence: Synthetic polypeptide
EVQLLESGGGLVQPGGSLRLSCAASGFTFSMYIMNWVRQAPGKGLEWVSSIVSSGGWTFYADSVKGRFTISRDNSKNTLYLQMNSLRAEDTAVYYCARGHYGMDVWGQGTTVTVSS

SEQ ID NO: 3123 - protein, 121 aa, Artificial Sequence
  Description of Artificial Sequence: Synthetic polypeptide
EVQLLESGGGLVQPGGSLRLSCAASGFTFSQYKMSWVRQAPGKGLEWVSSISSSGGTNYADSVKGRFTISRDNSKNTLYLQMNSLRAEDTAMYYCARRNYGDRPYWYFDLWGRGTLVTVSS

SEQ ID NO: 3124 - protein, 98 aa, Artificial Sequence
  Description of Artificial Sequence: Synthetic polypeptide
LSLVCKASGFTFSSNAMGWVRQAPGKGLEWVAGIDDDGSGTRYAPAVKGRATISRDNGQSTLRLQLNNLRAEDTGIYYCTKCAYSSGCDYEAGYIDAW

SEQ ID NO: 3125 - protein, 125 aa, Artificial Sequence
  Description of Artificial Sequence: Synthetic polypeptide
AVTLDESGGGLQTPGGALSLVCKASGFTFSSNAMGWVRQAPGKGLEWVAGIDDDGSSTRYAPAVKGRATISRDNGQSTVRLQLNNLRAEDTGIYYCTKCAYSSGCDYEAGYIDAWGHGTEVIVSS

SEQ ID NO: 3126 - protein, 126 aa, Artificial Sequence
  Description of Artificial Sequence: Synthetic polypeptide
QVQLVQSGSELKKPGASVKVSCKASGYTFTNYGMNWVRQAPGQGLEWMGWINTYTGEPTYADDFTGRFVFSLDTSVSTAYLQISSLKAEDTAVYYCARNPINYYGINYEGYVMDYWGQGTLVTVSS

SEQ ID NO: 3127 - protein, 126 aa, Artificial Sequence
  Description of Artificial Sequence: Synthetic polypeptide
QVQLVQSGSELKKPGASVKVSCKASGYTFTNYGMNWVRQAPGQGLEWMGWINTYTGEPTYADDFTGRFVFSLDTSVSTAYLQISSLKAEDTAVYFCARNPINYYGINYEGYVMDYWGQGTLVTVSS

SEQ ID NO: 3128 - protein, 126 aa, Artificial Sequence
  Description of Artificial Sequence: Synthetic polypeptide
QVQLVQSGSELKKPGASVKVSCKASGYTFTNYGMNWVRQAPGQGLEWMGWINTYTGEPTYADDFTGRFVFSLDTSVSTAYLQISSLKAEDTATYFCARNPINYYGINYEGYVMDYWGQGTLVTVSS

SEQ ID NO: 3129 - protein, 118 aa, Artificial Sequence
  Description of Artificial Sequence: Synthetic polypeptide
QVQLQESGPGLLKPSETLSLTCTVSGGSVSLYYWSWIRQSPGKEPEWIGYIYSSGSTDYNPSLRSRVTISLDTSNNRFSLNLRSVTAADTAVYWCARSASIRGWFDPWGQGTLVTVSS

SEQ ID NO: 3130 - protein, 133 aa, Artificial Sequence
  Description of Artificial Sequence: Synthetic polypeptide
VQLLESGGGLVQPGGSLRLSCAASGFTFSTYAMSWVRQAPGEGLEWVSDINVGGVTTYYADSVKGRFTISRDNSKNTLYLQMNSLRVEDTAMYYCVRRSGPDRNSSPADFWGQGSLVIVSSGSASAPTLFPLV

SEQ ID NO: 3131 - protein, 109 aa, Artificial Sequence
  Description of Artificial Sequence: Synthetic polypeptide
SGPVLVKPGASVKISCKASGYSFTGYYMFWVKQSPEKSLEWIGEINPSTGGATYNLKFKAKATLTVDKSSNTAYMQLKSLTSEDSAVYYCARLDALDYWGQGTSVTVSS

SEQ ID NO: 3132 - protein, 113 aa, Artificial Sequence
  Description of Artificial Sequence: Synthetic polypeptide
QVQLVQSGAEVKKPGASVKVSCKASGYTFTSYWMHWVRQAPGQGLEWMGNINPSNGGTNYNEKFKSRVTMTRDTSTSTAYMELSSLRSEDTAVYYCELGQGYWGQGTLVTVSS

SEQ ID NO: 3133 - protein, 113 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFKSRATMTRDTSTSTAYMELSSLRSEDTAVYYCELGQGYWGQGTLVTVSS

SEQ ID NO: 3134 - protein, 113 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFKSRATLTVDKSTSTAYMELSSLRSEDTAVYYCELGQGYWGQGTLVTVSS

SEQ ID NO: 3135 - protein, 113 aa, Artificial Sequence
  Description of Artificial Sequence: Synthetic polypeptide
QVQLVQSGAEVVKPGASVKLSCKASGYTFTSYWMHWVKQAPGQGLEWIGNINPSNGGTNYNEKFKSRATLTRDTSTSTAYMELSSLRSEDTAVYYCELGQGYWGQGTLVTVSS

SEQ ID NO: 3136 - protein, 113 aa, Artificial Sequence
  Description of Artificial Sequence: Synthetic polypeptide
QVQLVQSGAEVVKPGASVKLSCKASGYTFTSYWMHWVKQRPGQGLEWIGNINPSNGGTNYNEKFKSKATLTVDTSSSTAYMELSSLRSEDSAVYYCELGQGYWGQGTLVTVSS

SEQ ID NO: 3137 - protein, 113 aa, Artificial Sequence
  Description of Artificial Sequence: Synthetic polypeptide
QVQLVQSGAEVKKPGASVKVSCKASGYTFTSYWMHWVKQRPGQGLEWIGNINPSNGGTNYNEKFKSKATLTVDKSTSTAYMELSSLRSEDTAVYYCELGQGYWGQGTLVTVSS

SEQ ID NO: 3138 - protein, 113 aa, Artificial Sequence
  Description of Artificial Sequence: Synthetic polypeptide
QVQLVQSGAEVVKPGASVKLSCKASGYTFTSYWMHWVKQRPGQGLEWIGNINPSNGGTNYNEKFKSKATLTVDKSTSTAYMELSSLRSEDTAVYYCELGQGYWGQGTLVTVSS

SEQ ID NO: 3139 - protein, 113 aa, Artificial Sequence
  Description of Artificial Sequence: Synthetic polypeptide
QVQLVQSGAEVVKPGASVKLSCKASGYTFTSYWMHWVKQRPGQGLEWIGNINPSNGGTNYNEKFKSKATLTVDKSSSTAYMELSSLRSEDSAVYYCELGQGYWGQGTLVTVSS

SEQ ID NO: 3140 - protein, 113 aa, Artificial Sequence
  Description of Artificial Sequence: Synthetic polypeptide
QVQLVQSGAEVKKPGASVKVSCKASGYTFTSYWMHWVRQAPGQGLEWMGNINPSNGGTNYNEKFKSRVTMTRDTSTSTVYMELSSLRSEDTAVYYCELGQGYWGQGTLVTVSS

SEQ ID NO: 3141 - protein, 113 aa, Artificial Sequence
  Description of Artificial Sequence: Synthetic polypeptide
QVQLVQSGAEVKKPGASVKVSCKASGYTFTSYWMHWVRQRPGQGLEWIGNINPSNGGTNYNEKFKSRATMTRDTSTSTAYMELSSLRSEDTAVYYCELGQGYWGQGTLVTVSS

SEQ ID NO: 3142 - protein, 113 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFKSKATMTRDTSTSTAYMELSSLRSEDTAVYYCELGQGYWGQGTLVTVSS

SEQ ID NO: 3143 - protein, 113 aa, Artificial Sequence
  Description of Artificial Sequence: Synthetic polypeptide
QVQLVQSGAEVKKPGASVKVSCKASGYTFTSYWMHWVRQRPGQGLEWIGNINPSNGGTNYNEKFKSKATMTRDTSTSTAYMELSSLRSEDTAVYYCELGQGYWGQGTLVTVSS

SEQ ID NO: 3144 - protein, 113 aa, Artificial Sequence
  Description of Artificial Sequence: Synthetic polypeptide
QVQLVQSGAEVKKPGASVKVSCKASGYTFTSYWMHWVKQRPGQGLEWIGNINPSNGGTNYNEKFKSKATMTRDTSTSTAYMELSSLRSEDTAVYYCELGQGYWGQGTLVTVSS

SEQ ID NO: 3145 - protein, 113 aa, Artificial Sequence
  Description of Artificial Sequence: Synthetic polypeptide
QVQLVQSGAEVKKPGASVKVSCKASGYTFTSYWMHWVKQRPGQGLEWIGNINPSNGGTNYNEKFKSKATMTVDTSTSTAYMELSSLRSEDTAVYYCELGQGYWGQGTLVTVSS

SEQ ID NO: 3146 - protein, 113 aa, Artificial Sequence
  Description of Artificial Sequence: Synthetic polypeptide
QVQLVQSGAEVKKPGASVKVSCKASGYTFTSYWMHWVKQRPGQGLEWIGNINPSNGGTNYNEKFKSKATLTVDTSTSTAYMELSSLRSEDTAVYYCELGQGYWGQGTLVTVSS

SEQ ID NO: 3147 - protein, 113 aa, Artificial Sequence
  Description of Artificial Sequence: Synthetic polypeptide
QVQLVQSGAEVKKPGASVKVSCKASGYTFTSYWMHWVRQRPGQGLEWMGNINPSNGGTNYNEKFKSRVTMTRDTSTSTAYMELSSLRSEDTAVYYCELGQGYWGQGTLVTVSS

SEQ ID NO: 3148 - protein, 119 aa, Artificial Sequence
  Description of Artificial Sequence: Synthetic polypeptide
QVQLQQPGIEVVKPGASVKLSCKASGYTFISNWMHWLRQRPGQGLEWIGEIDPSDTYTDYNQKFKGKATLTVDKSSTTAYMLLSSLTSEDSAVYFCARGGMIVYVLDSWGQGTSVTVSS

SEQ ID NO: 3149 - protein, 119 aa, Artificial Sequence
  Description of Artificial Sequence: Synthetic polypeptide
QVQLQQPGAELVKPGASVKLSCKASGYTFITYWMHWMKQRPGQGLEWIGEIDPSDSYTDYNQKFKGKATLTVDKSSSTAYMQLSSLTSEDSAVYYCARGSNVLYVLDYWGQGTSVTVSS

SEQ ID NO: 3150 - protein, 460 aa, Artificial Sequence
  Description of Artificial Sequence: Synthetic polypeptide
MAWVWTLPFLMAAAQSVQAEVQLVESGGGLVQPGGSLRLSCAASGFTFSNYWMSWVRQAPGKGLEWVATIKQDGSQKNYVDSVKGRFTISRDNAKNSLYLRLNSLRAEDTAVYYCATELFDLWGRGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3151 - protein, 246 aa, Artificial Sequence
  Description of Artificial Sequence: Synthetic polypeptide
MEFGLSWVFLVAILEGVQCEVQLVESGGGLVQPGGSLRLSCAASGFTFSNYWMSWVRQAPGKGLEWVATIKQDGSQKNYVDSVKGRFTISRDNAKNSLYLRLNSLRAEDTAVYYCATELFDLWGRGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCP

SEQ ID NO: 3152 - protein, 115 aa, Artificial Sequence
  Description of Artificial Sequence: Synthetic polypeptide
EVQLVESGGGLVQPGGSLRLSCAASGFTFSNYGMNWVRQAPGKGLEWVSMIYYDSSEKHYADSVKGRFTISRDNAKNSLYLQMNSLRDEDTAVYYCARGTTPDYWGQGTMVTVSS

SEQ ID NO: 3153 - protein, 115 aa, Artificial Sequence
  Description of Artificial Sequence: Synthetic polypeptide
EVQLVESGGGLVQPGGSLRLSCAASGFTFSNYGMNWVRQAPGKGLEWVSMIYYDSSEKHYADSVKGRFTISRDNAKNSLYLQMNSLRDEDTAVYYCARGTTPDYWGQGTLVTVSS

SEQ ID NO: 3154 - protein, 115 aa, Artificial Sequence
  Description of Artificial Sequence: Synthetic polypeptide
EVQLVESGGGLVQPGGSLRLSCAASGFTFSNYGMNWVRQAPGKGLEWVSMIYYDSSEKHYADSVKGRFTISRDNAKNSLYLQMNSLRDEDTAVYYCARGTTPDYWGQGTTVTVSS

SEQ ID NO: 3155 - protein, 115 aa, Artificial Sequence
  Description of Artificial Sequence: Synthetic polypeptide
QVQLVESGGGVVQPGRSLRLSCAASGFTFSNYGMNWVRQAPGKGLEWVAMIYYDSSEKHYADSVKGRFTISRDNSKNTLYLQMNSLRAEDTAVYYCARGTTPDYWGQGTMVTVSS

SEQ ID NO: 3156 - protein, 115 aa, Artificial Sequence
  Description of Artificial Sequence: Synthetic polypeptide
QVQLVESGGGVVQPGRSLRLSCAASGFTFSNYGMNWVRQAPGKGLEWVAMIYYDSSEKHYADSVKGRFTISRDNSKNTLYLQMNSLRAEDTAVYYCARGTTPDYWGQGTLVTVSS

SEQ ID NO: 3157 - protein, 115 aa, Artificial Sequence
  Description of Artificial Sequence: Synthetic polypeptide
QVQLVESGGGVVQPGRSLRLSCAASGFTFSNYGMNWVRQAPGKGLEWVAMIYYDSSEKHYADSVKGRFTISRDNSKNTLYLQMNSLRAEDTAVYYCARGTTPDYWGQGTTVTVSS

SEQ ID NO: 3158 - protein, 115 aa, Artificial Sequence
  Description of Artificial Sequence: Synthetic polypeptide
EVQLLESGGGLVQPGGSLRLSCAASGFTFSNYGMNWVRQAPGKGLEWVSMIYYDSSEKHYADSVKGRFTISRDNSKNTLYLQMNSLRAEDTAVYYCAKGTTPDYWGQGTMVTVSS

SEQ ID NO: 3159 - protein, 115 aa, Artificial Sequence
  Description of Artificial Sequence: Synthetic polypeptide
EVQLLESGGGLVQPGGSLRLSCAASGFTFSNYGMNWVRQAPGKGLEWVSMIYYDSSEKHYADSVKGRFTISRDNSKNTLYLQMNSLRAEDTAVYYCAKGTTPDYWGQGTLVTVSS

SEQ ID NO: 3160 - protein, 115 aa, Artificial Sequence
  Description of Artificial Sequence: Synthetic polypeptide
EVQLLESGGGLVQPGGSLRLSCAASGFTFSNYGMNWVRQAPGKGLEWVSMIYYDSSEKHYADSVKGRFTISRDNSKNTLYLQMNSLRAEDTAVYYCAKGTTPDYWGQGTTVTVSS

SEQ ID NO: 3161 - protein, 115 aa, Artificial Sequence
  Description of Artificial Sequence: Synthetic polypeptide
EVQLVESGGGVVQPGRSLRLSCAASGFTFSNYGMNWVRQAPGKGLEWVAMIYYDSSEKHYADSVKGRFTISRDNSKNTLYLQMNSLRAEDTAVYYCARGTTPDYWGQGTMVTVSS

SEQ ID NO: 3162 - protein, 113 aa, Artificial Sequence
  Description of Artificial Sequence: Synthetic polypeptide
DVVLTQSPLSLPVTLGQPASISCRSSQSLEYSDGYTFLEWFLQKPGQSPQLLIYEVSNRFSGVPDRFSGSGSGTDFTLKISRVEAEDVGVYYCFQATHDPLTFGQGTKLEIKR

SEQ ID NO: 3163 - protein, 113 aa, Artificial Sequence; identical to SEQ ID NO: 3162
  Description of Artificial Sequence: Synthetic polypeptide

SEQ ID NO: 3164 - protein, 120 aa, Artificial Sequence
  Description of Artificial Sequence: Synthetic polypeptide
EVQLVQSGAEVKKPGASVKVSCKASGYTFTSHGISWVRQAPGQGLDWMGWISPYSGNTNYAQKLQGRVTMTTDTSTSTAYMELSSLRSEDTAVYYCARVGSGPYYYMDVWGQGTLVTVSS

SEQ ID NO: 3165 - protein, 121 aa, Artificial Sequence
  Description of Artificial Sequence: Synthetic polypeptide
EVQLVQSGSEVKKPGASVKLSCKTSGYTFTNSAIHWVRQAPGQRLEWMGWINAGNGNTKYSQKFQGRVTITRDTSASTAYMELSSLRSEDTAVYYCAWAYCGGDCYSLDYWGQGTLVTVSS

SEQ ID NO: 3166 - protein, 126 aa, Artificial Sequence
  Description of Artificial Sequence: Synthetic polypeptide
EVQLLESGGDLVRPGGSLRLTCEGSGFNFFTQTIHWVRQAPGKGLEWVASISSDSNYIYHADSLKGRFTVSRDNAQDSVFLQMNSLRVEDTAVYYCARDILLEPLAPHYYYGLDVWGQGTTVTVSS

SEQ ID NO: 3167 - protein, 117 aa, Artificial Sequence
  Description of Artificial Sequence: Synthetic polypeptide
EVQLQESGPGLVKPSETLSLTCTVSGGSISGYYWSWIRQSPGKGLEWIGEIFHTGRTYYNPSLRSRLTISVDTSKNQFSLKLSSLTAADTAVYYCARDSAFGSFDYWGQGTLVTVSS

SEQ ID NO: 3168 - protein, 120 aa, Artificial Sequence
  Description of Artificial Sequence: Synthetic polypeptide
EVQLQESGPGLVKPSETLSLTCNVSGGSISSYYWSWIRQPPGKGLEWIGNIYYSGSTNYNPSLKSRVTISVDTSKSQFSLKLSSVTAADTAVYYCARALDFWSGQYFDYWGQGTLVTVSS

SEQ ID NO: 3169 - protein, 126 aa, Artificial Sequence
  Description of Artificial Sequence: Synthetic polypeptide
EVQLVESGGGLVQPGRSLRLSCAASGFTFDDYAMHWVRQAPGKGLEWVAVISYDGSNKYYADSVKGRFTISRDNSKNTLYLQMNSLRAEDTAVYYCARERVYSSGKEGYYYGMDVWGQGTMVTVSS

SEQ ID NO: 3170 - protein, 117 aa, Artificial Sequence
  Description of Artificial Sequence: Synthetic polypeptide
EVQLVESGGGVVQPGTSLRLSCAASGFPFSSYGMHWVRQAPGKGLEWVAAISGDGILKYYTDSVKGRFTISRDNSKNTLYLQMNNLSGEDTGLYYCARNYDNSLDYWGQGTLVTVSS

SEQ ID NO: 3171 - protein, 120 aa, Artificial Sequence
  Description of Artificial Sequence: Synthetic polypeptide
EVQLVQSGAEVKKPGASVKVSCKVSGHSLSELTIHWVRQAPGKGLEWMGGFDPEDGRGTYAPNFRGRVTMTEDTSTDTAYMELSGLRSEDAAVYYCATLLGEYDSYFDLWGRGTLVTVSS

SEQ ID NO: 3172 - protein, 120 aa, Artificial Sequence
  Description of Artificial Sequence: Synthetic polypeptide
EVQLVQSGAEVKKPGASVKVSCKASGYIFTNYDIAWVRQAPGQGLEWMGWMNPDSGNTGFVQKFKGRVTATSNTDITTAYMELSSLTSEDTAVYYCARDRFGSGYDLDHWGQGTLVTVSS

SEQ ID NO: 3173 - protein, 117 aa, Artificial Sequence
  Description of Artificial Sequence: Synthetic polypeptide
EVQLVESGGGLVQPGGSLRLSCAASGFTSSSYAMTWVRQAPGKGLEWVSGISGSGESTYYADSVKGRFTISRDNSKNTLYLQMNSLRVEDTAIYYCARQGYGAHDYWGQGTLVTVSS

SEQ ID NO: 3174 - protein, 126 aa, Artificial Sequence
  Description of Artificial Sequence: Synthetic polypeptide
EVQLLESGGGLVKPGGSLRLSCAASGFTFDDYAMHWVRQAPGKGLEWVSLISWDGGSTYYADSVKGRFTISRDNSKNSLYLQMNSLRAEDTALYYCAKDIPKVGGYSYGYGALGYWGQGTPVTVSS

SEQ ID NO: 3175 - protein, 115 aa, Artificial Sequence
  Description of Artificial Sequence: Synthetic polypeptide
EVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARSTSLSVWGQGTLVTVSS

SEQ ID NO: 3176 - protein, 117 aa, Artificial Sequence
  Description of Artificial Sequence: Synthetic polypeptide
EVQLQESGAGLLKPSETLSLTCAVYGGSFSGYYWSWIRQPPGKGLEWIGEINHSGSTNYNPSLKSRVTISVDTSKNQFSLKLSSVTAADTAVYYCARDDGAGVFDLWGRGTLVTVSS

SEQ ID NO: 3177 - protein, 123 aa, Artificial Sequence
  Description of Artificial Sequence: Synthetic polypeptide
EVQLVQSGAEVKEPGASVKVSCKASGYTFTDYYIQWVRQAPGHGLEWMGWINPKTGGTNYLQKFQGRVTMTRDTSTRTAYMELSSLRSDDTAFYYCVREDMNTVLATSWFDPWGQGTLVTVSS

SEQ ID NO: 3178 - protein, 138 aa, Artificial Sequence
  Description of Artificial Sequence: Synthetic polypeptide
MVLGLKWVFFVVFYQGVHCEVQLVESGGGLVQPKGSLKLSCAASGFTFNTYAMHWVRQAPGKGLEWVARIRSKSSNYATYYADSVKDRFTISRDDSQSMLYLQMNNLKTEDTAMYYCVRPLKWYFDVWGTGTTVTVSS

SEQ ID NO: 3179 - protein, 142 aa, Artificial Sequence
  Description of Artificial Sequence: Synthetic polypeptide
MDSRLNLVFLVLILKGVQCDVQLVESGGDLVQPGGSRKLSCAASGFTFSSFGMHWVRQAPEKGLEWVAYINSGSSTIYYADTVKGRFTISRDNPKNTLFLQMTSLRSEDTAMYYCARGNNPGTGYYYSMDYWGQGTSVTVSS

SEQ ID NO: 3180 - protein, 142 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGNNPGTGYYYAMDYWGQGTSVTVSS

SEQ ID NO: 3181 - protein, 113 aa, Artificial Sequence; identical to SEQ ID NO: 3140
  Description of Artificial Sequence: Synthetic polypeptide

SEQ ID NO: 3182 - protein, 112 aa, Artificial Sequence
  Description of Artificial Sequence: Synthetic polypeptide
QVQLVQSGAEWKPGASVKLSCKASGYTFTSYWMHWVKQAPGQGLEWIGNINPSNGGTNYNEKFKSRATLTRDTSTSTAYMELSSLRSEDTAVYYCELGQGYWGQGTLVTVSS

SEQ ID NO: 3183 - protein, 112 aa, Artificial Sequence
  Description of Artificial Sequence: Synthetic polypeptide
QVQLVQSGAEWKPGASVKLSCKASGYTFTSYWMHWVKQRPGQGLEWIGNINPSNGGTNYNEKFKSKATLTVDTSSSTAYMELSSLRSEDSAVYYCELGQGYWGQGTLVTVSS

SEQ ID NO: 3184 - protein, 113 aa, Artificial Sequence; identical to SEQ ID NO: 3137
  Description of Artificial Sequence: Synthetic polypeptide

SEQ ID NO: 3185 - protein, 113 aa, Artificial Sequence; identical to SEQ ID NO: 3138
  Description of Artificial Sequence: Synthetic polypeptide

SEQ ID NO: 3186 - protein, 112 aa, Artificial Sequence
  Description of Artificial Sequence: Synthetic polypeptide
QVQLVQSGAEWKPGASVKLSCKASGYTFTSYWMHWVKQRPGQGLEWIGNINPSNGGTNYNEKFKSKATLTVDKSSSTAYMELSSLRSEDSAVYYCELGQGYWGQGTLVTVSS

SEQ ID NO: 3187 - protein, 113 aa, Artificial Sequence; identical to SEQ ID NO: 3141
  Description of Artificial Sequence: Synthetic polypeptide

SEQ ID NO: 3188 - protein, 113 aa, Artificial Sequence; identical to SEQ ID NO: 3142
  Description of Artificial Sequence: Synthetic polypeptide

SEQ ID NO: 3189 - protein, 113 aa, Artificial Sequence; identical to SEQ ID NO: 3143
  Description of Artificial Sequence: Synthetic polypeptide

SEQ ID NO: 3190 - protein, 113 aa, Artificial Sequence; identical to SEQ ID NO: 3144
  Description of Artificial Sequence: Synthetic polypeptide

SEQ ID NO: 3191 - protein, 113 aa, Artificial Sequence; identical to SEQ ID NO: 3145
  Description of Artificial Sequence: Synthetic polypeptide

SEQ ID NO: 3192 - protein, 113 aa, Artificial Sequence; identical to SEQ ID NO: 3146
  Description of Artificial Sequence: Synthetic polypeptide

SEQ ID NO: 3193 - protein, 113 aa, Artificial Sequence; identical to SEQ ID NO: 3147
  Description of Artificial Sequence: Synthetic polypeptide

SEQ ID NO: 3194 - protein, 113 aa, Artificial Sequence; identical to SEQ ID NO: 3132
  Description of Artificial Sequence: Synthetic polypeptide

SEQ ID NO: 3195 - protein, 113 aa, Artificial Sequence; identical to SEQ ID NO: 3133
  Description of Artificial Sequence: Synthetic polypeptide

SEQ ID NO: 3196 - protein, 113 aa, Artificial Sequence; identical to SEQ ID NO: 3134
  Description of Artificial Sequence: Synthetic polypeptide

SEQ ID NO: 3197 - protein, 447 aa, Artificial Sequence; identical to SEQ ID NO: 3009
  Description of Artificial Sequence: Synthetic polypeptide

SEQ ID NO: 3198 - protein, 447 aa, Artificial Sequence; identical to SEQ ID NO: 3010
  Description of Artificial Sequence: Synthetic polypeptide

SEQ ID NO: 3199 - protein, 112 aa, Artificial Sequence
  Description of Artificial Sequence: Synthetic polypeptide
DVVMTQSPLSLSVSPGEPASISCRSSQSLFHSKGNTYLHWYLQKPGQSPKLLINRVSNRFSGVPDRFSGSGSGTDFTLKISRVEAEDVGVYFCSQSAHVPWTFGGGTKVEIK

SEQ ID NO: 3200 - protein, 112 aa, Artificial Sequence
  Description of Artificial Sequence: Synthetic polypeptide
DIVMTQSPLSLSVSPGEPASISCRSSQSLFHSKGNTYLHWYLQKPGQSPKLLIYRVSNRFSGVPDRFSGSGSGTDFTLKISRVEAEDVGVYFCSQSAHVPWTFGGGTKVEIK

SEQ ID NO: 3201 - protein, 112 aa, Artificial Sequence
  Description of Artificial Sequence: Synthetic polypeptide
DVVMTQSPLSLSVSPGEPASISCRSSQSLFHSKGNTYLHWYLQKPGQSPQLLINRVSNRFSGVPDRFSGSGSGTDFTLKISRVEAEDVGVYFCSQSAHVPWTFGGGTKVEIK

SEQ ID NO: 3202 - protein, 112 aa, Artificial Sequence
  Description of Artificial Sequence: Synthetic polypeptide
DIVMTQSPLSLSVSPGEPASISCRSSQSLFHSKGNTYLHWYLQKPGQSPQLLIYRVSNRFSGVPDRFSGSGSGTDFTLKISRVEAEDVGVYFCSQSAHVPWTFGGGTKVEIK

SEQ ID NO: 3203 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3204 - protein, 128 aa, Artificial Sequence
  Description of Artificial Sequence: Synthetic polypeptide
MKLPVRLLVLMFWIPASSSDVVMTQIPLYLSVSPGDQASISCRSSQSLFHSKGNTYLHWYLQKPGQSPKLLINRVSNRFSGVPDRFSGSGSGTDFTLKISGVEAEDLGVYFCSQSAHVPWTFGGGTKL

SEQ ID NO: 3205 - protein, 219 aa, Artificial Sequence
  Description of Artificial Sequence: Synthetic polypeptide
DVVMTQTPASVEAAVGGTVTIKCQASEDISSNLAWYQQKLGQPPKLLIYSASTLASGVPSRFKGSGSGTEFTLAISDLECADAATYYCQSYDGSSSSSYGIGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3206 - protein, 219 aa, Artificial Sequence
  Description of Artificial Sequence: Synthetic polypeptide
DVVMTQTPASVEAAVGGTVTIKCRASQSISVYLAWYQQKAGQPPKLLIYQASKLASGVPSRFKGSGSGTEFTLTISDLECADAATYYCQSYDGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3207 - protein, 220 aa, Artificial Sequence
  Description of Artificial Sequence: Synthetic polypeptide
ADIVMTQTPASVSEPVGGTVTIKCQASQSISSYLSWYQQKPGQPPKLLIYRASTLASGVPSRFKGSGSGTQFTLTISDLECADAATYYCQSYYYSSSITYRNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3208 - protein, 219 aa, Artificial Sequence
  Description of Artificial Sequence: Synthetic polypeptide
DVVMTQTPASVEAAVGGTVTIKCQASQSISSYLAWYQQKPGQPPKLLIYSASTLASGVPSRFKGRGSGTEFTLTISDLECADAATYYCQSYDGSSGSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3209 - protein, 220 aa, Artificial Sequence
  Description of Artificial Sequence: Synthetic polypeptide
ADIVMTQTPASVEAAVGGAVTIKCQATQSIGNNLAWYQQKPGQPPKLLIYRASTLASGVPSRFKGSGSGTEFTLTISDLECADAATYYCQSYYYSSSITYHNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3210 - protein, 220 aa, Artificial Sequence
  Description of Artificial Sequence: Synthetic polypeptide
ADIVMTQTPASVEAAVGGTVTIKCQASQSISDYLSWYQQKPGQPPKLLIYRASTLASGVPSRFKGSGSGTQFTLTISDLECADAATYYCQSYYYSSSITYRNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3211 - protein, 220 aa, Artificial Sequence
  Description of Artificial Sequence: Synthetic polypeptide
ADVVMTQTPASVEAAVGGTVTIKCQASQSISSYLSWYQQKPGQPPKLLIYRASTLASGVPSRFKGSGSGTQFTLTISDLECADAATYYCQSYYYSSSITYRNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3212 - protein, 219 aa, Artificial Sequence
  Description of Artificial Sequence: Synthetic polypeptide
DVVMTQTPASVEAAVGGTVTINCQASENIYRSLAWYQQKPGQPPKLLIYSASTLASGVPSRFKGSGSGTEFTLTISDLECADAATYYCQSYDGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3213 - protein, 219 aa, Artificial Sequence
  Description of Artificial Sequence: Synthetic polypeptide
DIVMTQIPASVEAAVGGTVTIKCQASQSIDSSLAWYQQKPGQPPKLLIYSASTLASGVPSRFKGSGSGTEFTLTIGDLECADAATYYCQSYDGSSSSYYGIGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3214 - protein, 219 aa, Artificial Sequence
  Description of Artificial Sequence: Synthetic polypeptide
DVVMTQTPSSVSAAVGGTVTIKCQASQSIGSSLAWYQQKPGQRPKLLIYAASTLASGVPSRFKGSGSGTEFTLTISDLECADAATYYCQSYDGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3215 - protein, 219 aa, Artificial Sequence
  Description of Artificial Sequence: Synthetic polypeptide
DIQMTQSPSTLSASVGDRVTITCQASQSISSYLAWYQQKPGKAPKLLIYSASTLASGVPSRFSGSGSGTEFTLTISSLQPDDFATYYCQSYDGSSGSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3216 - protein, 219 aa, Artificial Sequence
  Description of Artificial Sequence: Synthetic polypeptide
DIQMTQSPSTLSASVGDRVTITCQASQSISNYLAWYQQKPGKAPKLLIYSASTLASGVPSRFSGSGSGTEFTLTISSLQPDDFATYYCQSYEGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3217 - protein, 219 aa, Artificial Sequence
  Description of Artificial Sequence: Synthetic polypeptide
DIQMTQSPSTLSASVGDRVTITCQASEDISSNLAWYQQKPGKAPKLLIYSASTLASGVPSRFSGSGSGTEFTLTISSLQPDDFATYYCQSYDGSSSSSYGIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3218 - protein, 219 aa, Artificial Sequence
  Description of Artificial Sequence: Synthetic polypeptide
DIQMTQSPSTLSASVGDRVTITCRASQSISVYLAWYQQKPGKAPKLLIYQASKLASGVPSRFSGSGSGTEFTLTISSLQPDDFATYYCQSYDGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3219 - protein, 219 aa, Artificial Sequence
  Description of Artificial Sequence: Synthetic polypeptide
DVVMTQTPASVEAAVGGTVTIKCQASQSISNYLAWYQQKTGQPPKLLIYSASTLASGVPSRFKGSGSGTEFTLTISDLECADAATYYCQSYEGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3220 - protein, 219 aa, Artificial Sequence
  Description of Artificial Sequence: Synthetic polypeptide
DIQMTQSPSTLSASVGDRVTITCQATQSIGNNLAWYQQKPGKAPKLLIYRASTLASGVPSRFSGSGSGTEFTLTISSLQPDDFATYYCQSYYYSSSITYHNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3221 - protein, 219 aa, Artificial Sequence
  Description of Artificial Sequence: Synthetic polypeptide
DIQMTQSPSTLSASVGDRVTITCQASQSISDYLSWYQQKPGKAPKLLIYRASTLASGVPSRFSGSGSGTEFTLTISSLQPDDFATYYCQSYYYSSSITYRNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3222 - protein, 220 aa, Artificial Sequence
  Description of Artificial Sequence: Synthetic polypeptide
ADIQMTQSPSTLSASVGDRVTITCQASQSISDYLSWYQQKPGKAPKLLIYRASTLASGVPSRFSGSGSGTEFTLTISSLQPDDFATYYCQSYYYSSSITYRNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3223 - protein, 219 aa, Artificial Sequence
  Description of Artificial Sequence: Synthetic polypeptide
DIQMTQSPSTLSASVGDRVTITCQASENIYRSLAWYQQKPGKAPKLLIYSASTLASGVPSRFSGSGSGTEFTLTISSLQPDDFATYYCQSYDGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3224 - protein, 219 aa, Artificial Sequence
  Description of Artificial Sequence: Synthetic polypeptide
DIQMTQSPSTLSASVGDRVTITCQASQSIDSSLAWYQQKPGKAPKLLIYSASTLASGVPSRFSGSGSGTEFTLTISSLQPDDFATYYCQSYDGSSSSYYGIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3225 - protein, 219 aa, Artificial Sequence
  Description of Artificial Sequence: Synthetic polypeptide
DIQMTQSPSTLSASVGDRVTITCQASQSIGSSLAWYQQKPGKAPKLLIYSASTLASGVPSRFSGSGSGTEFTLTISSLQPDDFATYYCQSYEGSSSSYYGIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3226 - protein, 219 aa, Artificial Sequence
  Description of Artificial Sequence: Synthetic polypeptide
DIQMTQSPSTLSASVGDRVTITCQASQSIGSSLAWYQQKPGKAPKLLIYAASTLASGVPSRFSGSGSGTEFTLTISSLQPDDFATYYCQSYDGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3227 - protein, 111 aa, Artificial Sequence
  Description of Artificial Sequence: Synthetic polypeptide
DIQLTQSPSSLSASVGDRVTITCKASQSVDYDGDSYMNWYQQKPGKAPKFLICAASNLESGVPSRFSGSGSGTDFTLTISSLQPEDAATYYCQQSNEDPFTFGQGTKLEIK

SEQ ID NO: 3228 - protein, 111 aa, Artificial Sequence
  Description of Artificial Sequence: Synthetic polypeptide
DIQLTQSPSSLSASVGDRVTITCKASQSVDYDGDSYMNWYQQKPGKAPKFLIYAASNLESGVPSRFSGSGSGTDFTLTISSLQPEDAATYYCQQSNEDPFTFGQGTKLEIK

SEQ ID NO: 3229 - protein, 111 aa, Artificial Sequence
  Description of Artificial Sequence: Synthetic polypeptide
DIQLTQSPSSLSASVGDRVTITCKASQSVDYDGDSYMNWYQQKPGKAPKFLICAASNLESGVPSRFSGSGSGTDFTLTISSLQPEDFATYYCQQSNEDPFTFGQGTKLEIK

SEQ ID NO: 3230 - protein, 111 aa, Artificial Sequence
  Description of Artificial Sequence: Synthetic polypeptide
DIQLTQSPSSLSASVGDRVTITCKASQSVDYDGDSYMNWYQQKPGKAPKFLIYAASNLESGVPSRFSGSGSGTDFTLTISSLQPEDFATYYCQQSNEDPFTFGQGTKLEIK

SEQ ID NO: 3231 - protein, 111 aa, Artificial Sequence
  Description of Artificial Sequence: Synthetic polypeptide
DIQLTQSPSSLSASVGDRVTITCKASQSVDYDGDSYMNWYQQKPGKAPKLLIYAASNLESGVPSRFSGSGSGTDFTLTISSLQPEDFATYYCQQSNEDPFTFGQGTKLEIK

SEQ ID NO: 3232 - protein, 111 aa, Artificial Sequence
  Description of Artificial Sequence: Synthetic polypeptide
  MOD_RES (50)..(50): Any amino acid
  MOD_RES (53)..(53): Any amino acid
  MOD_RES (87)..(87): Any amino acid
DIQLTQSPSSLSASVGDRVTITCKASQSVDYDGDSYMNWYQQKPGKAPKXLIXAASNLESGVPSRFSGSGSGTDFTLTISSLQPEDXATYYCQQSNEDPFTFGQGTKLEIK

SEQ ID NO: 3233 - protein, 112 aa, Artificial Sequence; identical to SEQ ID NO: 3199
  Description of Artificial Sequence: Synthetic polypeptide

SEQ ID NO: 3234 - protein, 112 aa, Artificial Sequence; identical to SEQ ID NO: 3200
  Description of Artificial Sequence: Synthetic polypeptide

SEQ ID NO: 3235 - protein, 111 aa, Artificial Sequence; identical to SEQ ID NO: 3232
  Description of Artificial Sequence: Synthetic polypeptide
  MOD_RES (50)..(50): Any amino acid
  MOD_RES (53)..(53): Any amino acid
  MOD_RES (87)..(87): Any amino acid

SEQ ID NO: 3236 - protein, 218 aa, Artificial Sequence
  Description of Artificial Sequence: Synthetic polypeptide
DIQLTQSPSSLSASVGDRVTITCKASQSVDYDGDSYMNWYQQKPGKAPKFLICAASNLESGVPSRFSGSGSGTDFTLTISSLQPEDFATYYCQQSNEDPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3237 - protein, 217 aa, Artificial Sequence
  Description of Artificial Sequence: Synthetic polypeptide
DIQLTQSPSSLSASVGDRVTITCKASQSVDYDGDSYMNWYQQKPGKAPKFLICAASNLESGVPSRFSGSGSGTDFTLTISSLQPEDFATYYCQQSNEDPFTFGQGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3238 - protein, 113 aa, Artificial Sequence
  Description of Artificial Sequence: Synthetic polypeptide
  MOD_RES (42)..(42): Any amino acid
  MOD_RES (89)..(89): Any amino acid
DIQMTQSPSSLSASVGDRVTITCKSIQTLLYSSNQKNYLAWXQQKPGKAPKLLIYWASIRKSGVPSRFSGSGSGTDFTLTISSLQPEDXATYYCQQYYSYPLTFGGGTKLEIK

SEQ ID NO: 3239 - protein, 220 aa, Artificial Sequence
  Description of Artificial Sequence: Synthetic polypeptide
DIQMTQSPSSLSASVGDRVTITCKSIQTLLYSSNQKNYLAWFQQKPGKAPKLLIYWASIRKSGVPSRFSGSGSGTDFTLTISSLQPEDLATYYCQQYYSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3240 - protein, 219 aa, Artificial Sequence
  Description of Artificial Sequence: Synthetic polypeptide
DIQMTQSPSSLSASVGDRVTITCKSIQTLLYSSNQKNYLAWFQQKPGKAPKLLIYWASIRKSGVPSRFSGSGSGTDFTLTISSLQPEDLATYYCQQYYSYPLTFGGGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3241 - protein, 112 aa, Artificial Sequence; identical to SEQ ID NO: 3201
  Description of Artificial Sequence: Synthetic polypeptide

SEQ ID NO: 3242 - protein, 217 aa, Artificial Sequence
  Description of Artificial Sequence: Synthetic polypeptide
AQAAELVMTQTPASVSAAVGGTVTINCQSSESVYNSRLSWFQQKPGQPPKLLIYFASTLASGVSSRFSGSGSGTEFTLTISGVQCDDAATYYCAGHFSNSVYTFGGGTEVVVTGDPVAPTVLIFPPSADLVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 3243 - protein, 220 aa, Artificial Sequence
  Description of Artificial Sequence: Synthetic polypeptide
AQAAELVMTQTPSSVSEPVGGTVTIKCQASQSIDSYLSWYQQKPGQPPKLLIYSASTLASGVPSRFKGSGSGTQFTLTISDLECADAATYYCQSNYWSTSYSYAVPFGGGTEVVVKGDPVAPTVLIFPPSADLVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 3244 - protein, 220 aa, Artificial Sequence; identical to SEQ ID NO: 3243
  Description of Artificial Sequence: Synthetic polypeptide

SEQ ID NO: 3245 - protein, 217 aa, Artificial Sequence
  Description of Artificial Sequence: Synthetic polypeptide
AQAAELDMTQTPASVSEPVGGTVTIKCQASQSISSYLAWYQQKPGQRPRLLIYETSTLASGVPSRFKGSGSGTEFTLTISDLECADAATYYCQSTYENPTYVSFGGGTEVGVKGDPVAPTVLIFPPSADLVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 3246 - protein, 218 aa, Artificial Sequence; identical to SEQ ID NO: 3020
  Description of Artificial Sequence: Synthetic polypeptide

SEQ ID NO: 3247 - protein, 239 aa, Artificial Sequence
  Description of Artificial Sequence: Synthetic polypeptide
MDSQAQVLILLLLWVSGTCGDIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYDLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3248 - protein, 228 aa, Artificial Sequence
  Description of Artificial Sequence: Synthetic polypeptide
MFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3249 - protein, 239 aa, Artificial Sequence
  Description of Artificial Sequence: Synthetic polypeptide
MDSQAQVLILLLLWVSGTCGDIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYDLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3250 - protein, 208 aa, Artificial Sequence
  Description of Artificial Sequence: Synthetic polypeptide
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIKRADAAPTVSIFPPSSEQLTSGGASVVCFLNNFYPKDINVKWKIDGSERQNGVLNSWTDQDSKDSTYSMSSTLTLTKD

SEQ ID NO: 3251 - protein, 238 aa, Artificial Sequence
  Description of Artificial Sequence: Synthetic polypeptide
MKLPVRLLVLMFWIPASSSDVVMTQSPLSLPVTLGQPASISCRSSQSLVHSNGNTYLHWFQQRPGQSPRRLIYKVSNRFSGVPDRFSGSGSGTDFTLKISRVEAEDVGVYYCSQSTHVPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3252 - protein, 239 aa, Artificial Sequence
  Description of Artificial Sequence: Synthetic polypeptide
MDSQAQVLILLLLWVSGTCGDIVMTQSPLSLPVTPGEPASISCKSSQSLLNSRTRKNYLAWYLQKPGQSPQLLIYWASTRESGVPDRFSGSGSGTDFTLKISRVEAEDVGVYYCKQSYDLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3253 - protein, 239 aa, Artificial Sequence
  Description of Artificial Sequence: Synthetic polypeptide
MDSQAQVLILLLLWVSGTCGDVVMTQSPLSLPVTLGQPASISCKSSQSLLNSRTRKNYLAWFQQRPGQSPRLRIYWASTRESGVPDRFSGSGSGTDFTLTISRVEAEDVGVYYCKQSYDLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3254 - protein, 238 aa, Artificial Sequence
  Description of Artificial Sequence: Synthetic polypeptide
MKLPVRLLVLMFWIPASSSEIVMTQTPLSLSITPGEQASISCRSSQSLVHSNGNTYLHWFLQKARPVSTLLIYKVSNRFSGVPDRFSGSGSGTDFTLKISRVEAEDFGVYYCSQSTHVPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3255 - protein, 238 aa, Artificial Sequence
  Description of Artificial Sequence: Synthetic polypeptide
MKLPVRLLVLMFWIPASSSDIVMTQTPLSLPVTPGEPASISCRSSQSLVHSNGNTYLHWYLQKPGQSPQLLIYKVSNRFSGVPDRFSGSGSGTDFTLKISRVEAEDVGVYYCSQSTHVPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3256 - protein, 239 aa, Artificial Sequence
  Description of Artificial Sequence: Synthetic polypeptide
MDSQAQVLILLLLWVSGTCGDIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYDLRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3257 - protein, 238 aa, Artificial Sequence
  Description of Artificial Sequence: Synthetic polypeptide
MGWSCIILFLVATATGVHSDIVMTQSPLSLPVTLGQPASISCRSSKSLLYKDGKTYLNWFQQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3258 - protein, 238 aa, Artificial Sequence
  Description of Artificial Sequence: Synthetic polypeptide
MGWSCIILFLVATATGVHSDIVMTQSPLSNPVTLGQPVSISCRSSKSLLYKDGKTYLNWFLQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3259 - protein, 238 aa, Artificial Sequence
  Description of Artificial Sequence: Synthetic polypeptide
MGWSCIILFLVATATGVHSDIVMTQDPLSNPVTLGQPVSISCRSSKSLLYKDGKTYLNWFLQRPGQSPQLLIYLMSTRASGVSDRFSGSGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3260 - protein, 144 aa, Artificial Sequence
  Description of Artificial Sequence: Synthetic polypeptide
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISRVDAEDLGVYFCSQSTHVPFTFGGGTKLEIKRADAAPTVSISHH

SEQ ID NO: 3261 - protein, 116 aa, Artificial Sequence
  Description of Artificial Sequence: Synthetic polypeptide
VQLQESGAELVMPGASVKMSCKASGYTFTDYWMHWVKQRPGQGLEWIGAIDPSDSYSSYNQNFKGKATLTVDGSSSTAYMQLSSLTSEDSAVYYCARRITEAGAWFAYWGQGTTVT

SEQ ID NO: 3262 - protein, 112 aa, Artificial Sequence
  Description of Artificial Sequence: Synthetic polypeptide
NDIVMTQSPASLAVSLGQRATISYRASKSVSTSGYSYMHWNQQKPGQPPRLLIYLVSNLESGVPARFSGSGSGTDFTLNIHPVEEEDAATYYCQHIRELTRSARGQSWKKRC

SEQ ID NO: 3263 - protein, 109 aa, Artificial Sequence
  Description of Artificial Sequence: Synthetic polypeptide
NQIVLTQSPAIMSASPGEKVTITCSASSSVSYMYWFQQKPGTSPKLWIYSTSNLASGVPARFSGSGSGTSYSLTISRMEAEDAATYYCQQRSSYPLTFGAGTKLELKRC

SEQ ID NO: 3264 - protein, 114 aa, Artificial Sequence
  Description of Artificial Sequence: Synthetic polypeptide
NDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPRTFGGGTKLEMKRC

SEQ ID NO: 3265 - protein, 110 aa, Artificial Sequence
  Description of Artificial Sequence: Synthetic polypeptide
NDIQMTQSPSSLSASVGDRVTITCRASQGIRNDLGWYQQKPGKAPKRLIYAASSLQSGVPSRFSGSGSGTEFTLTISSLQPEDFATFYCLQHNSLPLTFGGGTKVEIKRC

SEQ ID NO: 3266 - protein, 116 aa, Artificial Sequence
  Description of Artificial Sequence: Synthetic polypeptide
NDIQMTQSPDSLAVSLGERATINCKSSQSVSYSSNNKNYLAWYQQKPGQPPKLLIYWASTRESGVPDRISGSGSGTDFTLTISSLQAEDVAVYYCQQHYNTPLTFGGGTKVEIKRC

SEQ ID NO: 3267 - protein, 112 aa, Artificial Sequence
  Description of Artificial Sequence: Synthetic polypeptide
NEIVLTQSPGTLSLSPGERATLSCRASQSVSSNYLTWYQQKPGQAPRLLIYGASSRATGIPDRFSGSGSGTDFTLTISRLEPEDFAVYYCQQYGRSPPITFGQGTRLEIKRC

SEQ ID NO: 3268 - protein, 112 aa, Artificial Sequence
  Description of Artificial Sequence: Synthetic polypeptide
NGIVLTQSPGTLSLSPGERATFSCRASQSGSSTYLAWYQQKPGQAPRLLIYGASSRATGIPDRFSGSGSGTDFTLTISRLEPEDFAVYYCQQYGRSPPITFGQGTRLEIKRC

SEQ ID NO: 3269 - protein, 113 aa, Artificial Sequence; identical to SEQ ID NO: 3238
  Description of Artificial Sequence: Synthetic polypeptide
  MOD_RES (42)..(42): Any amino acid
  MOD_RES (89)..(89): Any amino acid

SEQ ID NO: 3270 - protein, 107 aa, Artificial Sequence [sequence omitted]

SEQ ID NO: 3271 - protein, 330 aa, Artificial Sequence; identical to SEQ ID NO: 2950
  Description of Artificial Sequence: Synthetic polypeptide

SEQ ID NO: 3272 - protein, 107 aa, Artificial Sequence [sequence omitted]

SEQ ID NO: 3273 - protein, 107 aa, Artificial Sequence [sequence omitted]

SEQ ID NO: 3274 - protein, 106 aa, Artificial Sequence; identical to SEQ ID NO: 3203
  Description of Artificial Sequence: Synthetic polypeptide

SEQ ID NO: 3275 - protein, 234 aa, Artificial Sequence
  Description of Artificial Sequence: Synthetic polypeptide
METDTLLLWLLLLMFPGTRCDIQMTQSPSSLSASLGERVSLTCRASQDIGGNLYWLQQGPDGTIKRLIYATSSLDSGVPKRFSGSRSGSDYSLTISSLESEDFVDYYCLQYSSSPWTFGGATKMEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3276 - protein, 234 aa, Artificial Sequence; identical to SEQ ID NO: 3275
  Description of Artificial Sequence: Synthetic polypeptide

SEQ ID NO: 3277 - protein, 238 aa, Artificial Sequence
  Description of Artificial Sequence: Synthetic polypeptide
MGWSCIILFLVATATGVHSDIVITQSPLSLPVTLGQPASISCRSSKSLLYKDGKTYLNWFQQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3278 - protein, 237 aa, Artificial Sequence
  Description of Artificial Sequence: Synthetic polypeptide
MGWSCIILFLVATATGVHSDIVMTQSPLSLPVTLGQPASISCRSSKSLLYKDGKTYLNWFQQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 3279 - protein, 238 aa, Artificial Sequence
  Description of Artificial Sequence: Synthetic polypeptide
MGWSCIILFLVATATGVHSDIVMTQSPLSLPVTLGQPASISCRSSKSLLYKDGKTYLNWFLQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3280 - protein, 237 aa, Artificial Sequence
  Description of Artificial Sequence: Synthetic polypeptide
MGWSCIILFLVATATGVHSDIVMTQSPLSLPVTLGQPASISCRSSKSLLYKDGKTYLNWFLQRPGQSPQLLIYLMSTRASGVSDRFSGGGSGTDFTLKISRVEAEDVGVYYCQQLVEYPLTFGQGTKLEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 3281 - protein, 237 aa, Artificial Sequence
  Description of Artificial Sequence: Synthetic polypeptide
MGWSCIILFLVATATGVHSDIVMTQSPLSNPVTLGQPVSISCRSSKSLLYKDGKTYLNWFLQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 3282 - protein, 237 aa, Artificial Sequence
  Description of Artificial Sequence: Synthetic polypeptide
MGWSCIILFLVATATGVHSDIVMTQDPLSLPVTLGQPASISCRSSKSLLYKDGKTYLNWFQQRPGQSPQLLIYLMSTRASGVSDRFSGSGSGTDFTLKISRVEAEDVGVYYCQQLVEYPLTFGQGTKLEIKRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 3283 - protein, 238 aa, Artificial Sequence; identical to SEQ ID NO: 3259
  Description of Artificial Sequence: Synthetic polypeptide

SEQ ID NO: 3284 - protein, 238 aa, Artificial Sequence
  Description of Artificial Sequence: Synthetic polypeptide
MGWSCIILFLVATATGVHSDIVMTQSPLSLPVTPGEPASISCRSSKSLLYKDGKTYLNWFLQRPGQSPQLLIYLMSTRASGVPDRFSGSGSGTDFTLKISRVEAEDVGVYYCQQLVEYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3285 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3286 - protein, 108 aa, Artificial Sequence
  Description of Artificial Sequence: Synthetic polypeptide
QSVLTQPPSVSVSPGQTARITCSGEALPMQFAHWYQQRPGKAPVIVVYKDSERPSGVPERFSGSSSGTTATLTITGVQAEDEADYYCQSPDSTNTYEVFGGGTKLTVL

SEQ ID NO: 3287 - protein, 108 aa, Artificial Sequence
  Description of Artificial Sequence: Synthetic polypeptide
SYELTQPPSVSVSPGQTARITCSGEALPMQFAHWYQQRPGKAPVIVVYKDSERPSGVPERFSGSSSGTTATLTITGVQAEDEADYYCQSPDSTNTYEVFGGGTKLTVL

SEQ ID NO: 3288 - protein, 106 aa, Artificial Sequence
  Description of Artificial Sequence: Synthetic polypeptide
DIQLTQSPSTLSASVGDRVTITCRASQSISGWLAWYQQKPGKAPKLLIYDASNLESGVPSRFSGSGSGTEFTLTISSLQPDDFATYYCQQYDNYWTFGQGTKVEIK

SEQ ID NO: 3289 - protein, 106 aa, Artificial Sequence
  Description of Artificial Sequence: Synthetic polypeptide
DIQMTQSPSTLSASVGDRVTITCRASQSISGWLAWYQQKPGKAPKLLIYDASNLESGVPSRFSGSGSGTEFTLTISSLQPDDFATYYCQQYDNYWTFGQGTKVEIK

SEQ ID NO: 3290 - protein, 107 aa, Artificial Sequence
  Description of Artificial Sequence: Synthetic polypeptide
EIVMTQSPSSLSASIGDRVTFTCRASHDISNYLAWFRQQPGKAPKSLIYAASSLQSGVPSRFSASGSGTDFTLTISSLQPEDFATYYCVQYRTYPLTFGQGTRLEIK

SEQ ID NO: 3291 - protein, 107 aa, Artificial Sequence
  Description of Artificial Sequence: Synthetic polypeptide
DIQMTQSPSSLSASIGDRVTFTCRASHDISNYLAWFRQQPGKAPKSLIYAASSLQSGVPSRFSASGSGTDFTLTISSLQPEDFATYYCVQYRTYPLTFGQGTRLEIK

SEQ ID NO: 3292 - protein, 108 aa, Artificial Sequence
  Description of Artificial Sequence: Synthetic polypeptide
QSVLTQPPSVSVAPGQTARITCSGDALPKHYAHWYQQKPGQVPIVVIYKDTERPSGIPERFSGSTSGTTVTLTISGVQAEDEAHYYCQSADVSSTYVVFGGGTKLTVL

SEQ ID NO: 3293 - protein, 107 aa, Artificial Sequence
  Description of Artificial Sequence: Synthetic polypeptide
SYELTQPPSVSVAPGQTARITCSGDALPKHYAHWYQQKPGQVPIVVIYKDTERPSGIPERFSGSTSGTTVTLTISGVQAEDEAHYYCQSADVSSTYVVFGGGTKLTV

SEQ ID NO: 3294 - protein, 113 aa, Artificial Sequence
  Description of Artificial Sequence: Synthetic polypeptide
DIVMSQSPSSLAVSVGEKVTMSCKSIQTLLYSSNQKNYLAWFQQKPGQSPKLLIYWASIRKSGVPDRFTGSGSGTDFTLTISSVKAEDLAVYYCQQYYSYPLTFGAGTKLELK

SEQ ID NO: 3295 - protein, 107 aa, Artificial Sequence; identical to SEQ ID NO: 3096
  Description of Artificial Sequence: Synthetic polypeptide

SEQ ID NO: 3296 - protein, 113 aa, Artificial Sequence
  Description of Artificial Sequence: Synthetic polypeptide
DIQMTQSPSSLSASVGDRVTITCKSIQTLLYSSNQKNYLAWFQQKPGKAPKLLIYWASIRKSGVPSRFSGSGSGTDFTLTISSLQPEDFATYYCQQYYSYPLTFGGGTKLEIK

SEQ ID NO: 3297 - protein, 113 aa, Artificial Sequence
  Description of Artificial Sequence: Synthetic polypeptide
DIQMTQSPSSLSASVGDRVTITCKSIQTLLYSSNQKNYLAWYQQKPGKAPKLLIYWASIRKSGVPSRFSGSGSGTDFTLTISSLQPEDFATYYCQQYYSYPLTFGGGTKLEIK

SEQ ID NO: 3298 - protein, 111 aa, Artificial Sequence
  Description of Artificial Sequence: Synthetic polypeptide
DIVLTQSPASLAVSLGQRATISCKASQSVDYDGDSYMNWYQQKPGQPPKFLICAASNLESGIPARFSGSGSGTDFTLNIHPVEEEDAATYYCQQSNEDPFTFGSGTKLEIK

SEQ ID NO: 3299 - protein, 131 aa, Artificial Sequence
  Description of Artificial Sequence: Synthetic polypeptide
METDTLLLWVLLLWVPGSTGDIVLTQSPASLAVSLGQRATISCKASQSVDYDGDSYMNWYQQKPGQPPKFLICAASNLESGIPARFSGSGSGTDFTLNIHPVEEEDAATYYCQQSNEDPFTFGSGTKLEIK

SEQ ID NO: 3300 - protein, 113 aa, Artificial Sequence; identical to SEQ ID NO: 3294
  Description of Artificial Sequence: Synthetic polypeptide

SEQ ID NO: 3301 - protein, 111 aa, Artificial Sequence; identical to SEQ ID NO: 3228
  Description of Artificial Sequence: Synthetic polypeptide

SEQ ID NO: 3302 - protein, 111 aa, Artificial Sequence; identical to SEQ ID NO: 3229
  Description of Artificial Sequence: Synthetic polypeptide

SEQ ID NO: 3303 - protein, 111 aa, Artificial Sequence; identical to SEQ ID NO: 3227
  Description of Artificial Sequence: Synthetic polypeptide

SEQ ID NO: 3304 - protein, 111 aa, Artificial Sequence; identical to SEQ ID NO: 3230
  Description of Artificial Sequence: Synthetic polypeptide

SEQ ID NO: 3305 - protein, 113 aa, Artificial Sequence; identical to SEQ ID NO: 3296
  Description of Artificial Sequence: Synthetic polypeptide

SEQ ID NO: 3306 - protein, 113 aa, Artificial Sequence; identical to SEQ ID NO: 3297
  Description of Artificial Sequence: Synthetic polypeptide

SEQ ID NO: 3307 - protein, 112 aa, Artificial Sequence
  Description of Artificial Sequence: Synthetic polypeptide
DVVMTQIPLYLSVSPGDQASISCRSSQSLFHSKGNTYLHWYLQKPGQSPKLLINRVSNRFSGVPDRFSGSGSGTDFTLKISGVEAEDLGVYFCSQSAHVPWTFGGGTKLEIR

SEQ ID NO: 3308 - protein, 113 aa, Artificial Sequence; identical to SEQ ID NO: 3085
  Description of Artificial Sequence: Synthetic polypeptide

SEQ ID NO: 3309 - protein, 131 aa, Artificial Sequence; identical to SEQ ID NO: 3299
  Description of Artificial Sequence: Synthetic polypeptide

SEQ ID NO: 3310 - protein, 111 aa, Artificial Sequence; identical to SEQ ID NO: 3298
  Description of Artificial Sequence: Synthetic polypeptide

SEQ ID NO: 3311 - protein, 112 aa, Artificial Sequence
  Description of Artificial Sequence: Synthetic polypeptide
DVLMTQTPLSLPVSLGDQASISCRSSQNIVHSNGNTYLEWYLQKPGQSPTLLIYKVSNRFSGVPDRFSGSGSGTDFTLKISRVEAEDLGVYYCFQGSHVPLTFGAGTKLELK

SEQ ID NO: 3312 - protein, 112 aa, Artificial Sequence
  Description of Artificial Sequence: Synthetic polypeptide
DVLMTQTPLSLPVSLGDQASISCRSSQSIVNSNGNTYLEWYLQKPGQSPKLLIYKVSNRFSGVPDRFSGSGSGTDFTLKISRVEAEDLGVYYCFQGSHVPLTFGAGTTLELK

SEQ ID NO: 3313 - protein, 106 aa, Artificial Sequence
  Description of Artificial Sequence: Synthetic polypeptide
QIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIK

SEQ ID NO: 3314 - protein, 111 aa, Artificial Sequence
  Description of Artificial Sequence: Synthetic polypeptide
DWMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 3315 - protein, 111 aa, Artificial Sequence
  Description of Artificial Sequence: Synthetic polypeptide
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPLTFGAGTKLEL

SEQ ID NO: 3316 - protein, 107 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLAISSLQPEDSATYYCLQDFIYPYTFGQGTKLEIR

SEQ ID NO: 3317 - protein, 107 aa, Artificial Sequence
  Description of Artificial Sequence: Synthetic polypeptide
DILMTQSPPSMSVSLGDTVSITCHASQGISSNIGWLQQKPGKSFKGLIYHGSTLEDGVPSRFSGSGSGAEFSLTISSLESEDFADYYCVQYAQFPYTFGGGTKLEIK

SEQ ID NO: 3318 - protein, 107 aa, Artificial Sequence
  Description of Artificial Sequence: Synthetic polypeptide
DIQMTQSPSSVSASVGDRVTITCRASQGIRSWLAWYQQKPGKAPKLLIYDASTLQSGVPSRFRGGGSGTDFTLTISSLQPEDFATYYCQQSYSTPLTFGGGTKVEIK

SEQ ID NO: 3319 - protein, 107 aa, Artificial Sequence
  Description of Artificial Sequence: Synthetic polypeptide
DILMTQSPSSMSVSLGDTVSITCHASQGIRNSIGWLQQKPGKSFKGLIYHATTLEDGVPSRFTGSGSGADFSLTISSLESEDFADYYCVQYAQFPYTFGGGTKLEIK

SEQ ID NO: 3320 - protein, 106 aa, Artificial Sequence
  Description of Artificial Sequence: Synthetic polypeptide
QIVLTQSPAIMSASPGEKVTITCSASSSVSYMHWFQQKPGTSPKLWIYSTSNLASGVPARFSGSGSGTSYSLTISRMEAEDAATYYCQQRSSYPLTFGAGTKLELK

SEQ ID NO: 3321 - protein, 110 aa, Artificial Sequence
  Description of Artificial Sequence: Synthetic polypeptide
QSELTQPPSASGSPGQSVTISCTGTSNDVGSYNYISWFQQHPGKAPKLMIYEVNKRPSGVPDRFSGSKSDNTASLTVSGLQAEDEADYYCTSYAGSHKWVFGGGTKLTVL

SEQ ID NO: 3322 - protein, 110 aa, Artificial Sequence
  Description of Artificial Sequence: Synthetic polypeptide
QSELTQPPSASGTPGQWVTISCSGSTSNIGNNYVYWYQQLPGTAPKLLIYTNNQRPSGVPDRFSGSKSGTSASLAISGLRSEDEADYYCATWDDSLYAPVFGGGTKVTVL

SEQ ID NO: 3323 - protein, 106 aa, Artificial Sequence
  Description of Artificial Sequence: Synthetic polypeptide
DIQMTQSPATLSLSPGERATLSCRASQTVSNYLAWYQQKPGQAPRLLIYDASNRATGIPARFSGSGSGTDFTLTISSLEPEDFAVYYCQQRSKWLSFGGGTKVEIK

SEQ ID NO: 3324 - protein, 113 aa, Artificial Sequence
  Description of Artificial Sequence: Synthetic polypeptide
DIQMTQSPDSLAVSLGERATINCKSSRSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 3325 - protein, 107 aa, Artificial Sequence
  Description of Artificial Sequence: Synthetic polypeptide
DIQMTQSPSTLSASVGDRVTITCRASQTISRWLAWYQHKPGKAPKLLIYKTSNLESGVPSRFSGSGSGTEFTLTISSLQPDDFATYYCQQYKSYSITFGPGTKVDIK

SEQ ID NO: 3326 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 3327 - protein, 107 aa, Artificial Sequence
  Description of Artificial Sequence: Synthetic polypeptide
DIQMTQSPASLSASVGDRVTITCRASQTIAGYLNWYQQTPGKAPNLLIYDASRLQSGVPSRFSGSGSGTDFTLSISGLQPEDFGTYYCQQSYTIPLTFGGGTKVEIK

SEQ ID NO: 3328 - protein, 113 aa, Artificial Sequence
  Description of Artificial Sequence: Synthetic polypeptide
DIQMTQSPDSLAVSLGERATINCKSSQSVLYSSNNKNYLAWYQHKAGQPPKLLIHWASSRASGVPDRFSGSGSGTDFTLTISSLQAEDVAVYYCQQFYSLPLTFGGGTKVEIR

SEQ ID NO: 3329 - protein, 116 aa, Artificial Sequence
  Description of Artificial Sequence: Synthetic polypeptide
AALTQPASVSANPGETVKITCSGGGSYAGSYYYGWYHGSYYYGWYQQKAPGSAPVTVIYDNTNRPSNIPSRFSGSLSGSTNTLTITGVRAEDEAVYFCGSADNSGAAFGAGTTLTV

SEQ ID NO: 3330 - protein, 111 aa, Artificial Sequence
  Description of Artificial Sequence: Synthetic polypeptide
AVTQPASVSANPGETVRITCSGGGSYAGTYYYGYRYGWYQQKSPGSAPVTVIYYNDKRPSDIPSRFSGSLSGSTNTLTITGVRADDEAVYFCGSYDNSGAAFGAGTTLTVL

SEQ ID NO: 3331 - protein, 115 aa, Artificial Sequence
  Description of Artificial Sequence: Synthetic polypeptide
DIVMTQSPDSLAVSLGERATINCKSSHSVLYSSNQKNYLAWYQQKPGQPPKLLIYWASTRESGVPDRFSGSGSGTDFTLTISSLQAEDVAVYYCHQYLSSLTFGQGTKLEIKRTV

SEQ ID NO: 3332 - protein, 115 aa, Artificial Sequence
  Description of Artificial Sequence: Synthetic polypeptide
DIVMTQSPDSLAVSLGERATINCKSSHSVLYSSNQKNYLAWYQQKPGQPPKLLIYWASTRESGVPDRFSGSGSGTDFTLTIINLQAEDVAVYYCHQYLSSLTFGQGTKLEIKRTV

SEQ ID NO: 3333 - protein, 115 aa, Artificial Sequence
  Description of Artificial Sequence: Synthetic polypeptide
DIVMTQSPDSLAVSLGERATINCKSSHSVLYSSNQKNYLAWYQQKPGQPPKLLIYWASTRESGVPDRFSGSGSGTDFTLTISSLHTEDVAVYYCHQYLSSLTFGQGTKLEIKRTV

SEQ ID NO: 3334 - protein, 115 aa, Artificial Sequence
  Description of Artificial Sequence: Synthetic polypeptide
DIVMTQSPDSLAVSLGERATINCKSSHSVLYSSNQKNYLAWYQQKPGQPPKLLIYWASTRESGVPDRFSGSGSGTDFTLTIINLHTEDVAVYYCHQYLSSLTFGQGTKLEIKRTV

SEQ ID NO: 3335 - protein, 105 aa, Artificial Sequence
  Description of Artificial Sequence: Synthetic polypeptide
DIQMTQSPSSLSASVGDRVTITCRASQSISSYLNWYQQKPGKAPKVLIYAASTLRSGVPSRFSGSGSGTDFTLSVSSLQPEDFATYYCQQSYHTPWTFGQGTKVE

SEQ ID NO: 3336 - protein, 105 aa, Artificial Sequence
  Description of Artificial Sequence: Synthetic polypeptide
DIQMTQSPSSLSASVGDRVTITCRASQGIGNYLAWYQQKPGKVPKLLIYTTSILQSGVPSRFSGSGSGTDFTLTISSLQPEDFATYYCQKYNSAPRTFGQGTRVD

SEQ ID NO: 3337 - protein, 108 aa, Artificial Sequence
  Description of Artificial Sequence: Synthetic polypeptide
TQTPLSLPVSLGDQASISCRSSQSLVHSNGNTYLHWYLQKPGQSPKLLIYRVSNRFSGVPDRFSGSRSGTDFTLKISRVEAEDLGVYFCSQSTHVPFTFGSGTKLEIK

SEQ ID NO: 3338 - protein, 112 aa, Artificial Sequence
  Description of Artificial Sequence: Synthetic polypeptide
DIVMTQSPLSLPVTPGEPASISCRSSKSLLYKDGKTYLNWFLQRPGQSPQLLIYLMSTRASGVPDRFSGSGSGTDFTLKISRVEAEDVGVYYCQQLVEYPLTFGGGTKVEIK

SEQ ID NO: 3339 - protein, 112 aa, Artificial Sequence
  Description of Artificial Sequence: Synthetic polypeptide
DIVMTQSPLSLPVTLGQPASISCRSSKSLLYKDGKTYLNWFQQRPGQSPQLLIYLMSTRASGVPDRFSGGGSGTDFTLKISRVEAEDVGVYYCQQLVEYPLTFGQGTKLEIK

SEQ ID NO: 3340 - protein, 112 aa, Artificial Sequence
  Description of Artificial Sequence: Synthetic polypeptide
DIVMTQSPLSLPVTLGQPASISCRSSKSLLYKDGKTYLNWFLQRPGQSPQLLIYLMSTRASGVPDRFSGGGSGTDFTLKISRVEAEDVGVYYCQQLVEYPLTFGQGTKLEIK

SEQ ID NO: 3341 - protein, 112 aa, Artificial Sequence
  Description of Artificial Sequence: Synthetic polypeptide
DIVMTQSPLSLPVTLGQPASISCRSSKSLLYKDGKTYLNWFLQRPGQSPQLLIYLMSTRASGVSDRFSGGGSGTDFTLKISRVEAEDVGVYYCQQLVEYPLTFGQGTKLEIK

SEQ ID NO: 3342 - protein, 112 aa, Artificial Sequence [sequence omitted]

SEQ ID NO: 3343 - protein, 112 aa, Artificial Sequence
  Description of Artificial Sequence: Synthetic polypeptide
DIVMTQDPLSLPVTLGQPASISCRSSKSLLYKDGKTYLNWFQQRPGQSPQLLIYLMSTRASGVSDRFSGSGSGTDFTLKISRVEAEDVGVYYCQQLVEYPLTFGQGTKLEIK

SEQ ID NO: 3344 - protein, 112 aa, Artificial Sequence
  Description of Artificial Sequence: Synthetic polypeptide
DIVMTQDPLSNPVTLGQPVSISCRSSKSLLYKDGKTYLNWFLQRPGQSPQLLIYLMSTRASGVSDRFSGSGSGTDFTLKISRVEAEDVGVYYCQQLVEYPLTFGQGTKLEIK

SEQ ID NO: 3345 - protein, 112 aa, Artificial Sequence
  Description of Artificial Sequence: Synthetic polypeptide
DIVITQSPLSLPVTLGQPASISCRSSKSLLYKDGKTYLNWFQQRPGQSPQLLIYLMSTRASGVPDRFSGGGSGTDFTLKISRVEAEDVGVYYCQQLVEYPLTFGQGTKLEIK

SEQ ID NO: 3346 - protein, 114 aa, Artificial Sequence
  Description of Artificial Sequence: Synthetic polypeptide
DIVMYQSPSSLAMSVGQKVIMNCKSSQSLLSSNNQKNYLAWYQQKPGQSPKLLVYFASTRDSGVPDRFIGSGSGTDFTLTISSVQAEDLADYFCQQHYTTPLTFGAGTKLELKR

SEQ ID NO: 3347 - protein, 113 aa, Artificial Sequence
  Description of Artificial Sequence: Synthetic polypeptide
DIVMTQSPSSLAMSVGQKVTMSCKSSQSLLNSRNQKNYLAWYQQKPGQSPKLLLYFASTRESGVPDRFIGSGSGTDFTLTISSVQAEDLADYFCQQHYTTPLTFGAGTKELKR

SEQ ID NO: 3348 - protein, 234 aa, Artificial Sequence
  Description of Artificial Sequence: Synthetic polypeptide
MSVLTQVLALLLLWLTGTRCEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3349 - protein, 246 aa, Artificial Sequence
  Description of Artificial Sequence: Synthetic polypeptide
MEAPAQLLFLLLLWLPDTTGEIVLTQSPATLSLSPGERATCDRLLSCRASQSVSSYLAWYQQKPCDRLGQAPRLLIYDASNRATGIPARFSGSGSGTDFTLTISSLEPCDRLEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3350 - protein, 113 aa, Artificial Sequence
  Description of Artificial Sequence: Synthetic polypeptide
DIVMTQTPLSLSVTPGQPASISCRSSQSLEYSDGYTFLEWYLQKPGQSPQLLIYEVSNRFSGVPDRFSGSGSGTDFTLKISRVEAEDVGVYYCFQATHDPLTFGQGTKLEIKR

SEQ ID NO: 3351 - protein, 113 aa, Artificial Sequence
  Description of Artificial Sequence: Synthetic polypeptide
DVVMTQSPLSLPVTLGQPASISCRSSQSLEYSDGYTFLEWFQQRPGQSPRRLIYEVSNRFSGVPDRFSGSGSGTDFTLKISRVEAEDVGVYYCFQATHDPLTFGQGTKLEIKR

SEQ ID NO: 3352 - protein, 113 aa, Artificial Sequence
  Description of Artificial Sequence: Synthetic polypeptide
DVVMTQSPLSLPVTLGQPASISCRSSQSLEYSDGYTFLEWYLQKPGQSPQLLIYEVSNRFSGVPDRFSGSGSGTDFTLKISRVEAEDVGVYYCFQATHDPLTFGQGTKLEIKR

SEQ ID NO: 3353 - protein, 115 aa, Artificial Sequence
  Description of Artificial Sequence: Synthetic polypeptide
EVQLVESGGGVVQPGRSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS

SEQ ID NO: 3354 - protein, 115 aa, Artificial Sequence
  Description of Artificial Sequence: Synthetic polypeptide
EVQLVESGGGLVQPGGSLRLSCAASGFTFSNYGMNWVRQAPGKGLEWVSMIYYDSSEKHYADSVKGRFTISRDNSKNTLYLQMNSLRAEDTAVYYCAKGTTPDYWGQGTMVTVSS

SEQ ID NO: 3355 - protein, 115 aa, Artificial Sequence
  Description of Artificial Sequence: Synthetic polypeptide
EVQLVESGGGLVQPGGSLRLSCAASGFTFSNYGMNWIRQAPGKGLEWIGMIYYDSSEKHYADSVKGRFTISRDNSKNTLYLQMNSLRAEDTAVYYCAKGTTPDYWGQGTMVTVSS

SEQ ID NO: 3356 - protein, 113 aa, Artificial Sequence
  Description of Artificial Sequence: Synthetic polypeptide
DVVLTQSPLSLPVTLGQPASISCRSSQSLEYSDGYTFLEWFQQRPGQSPRLLIYEVSNRFSGVPDRFSGSGSGTDFTLKISRVEAEDVGVYYCFQATHDPLTFGQGTKLEIKR

SEQ ID NO: 3357 - protein, 113 aa, Artificial Sequence
  Description of Artificial Sequence: Synthetic polypeptide
DVVLTQSPLSLPVTLGQPASISCRSSQSLEYSDGYTFLEWFQQRPGQSPRRLIYEVSNRFSGVPDRFSGSGSGTDFTLKISRVEAEDVGVYYCFQATHDPLTFGQGTKLEIKR

SEQ ID NO: 3358 - protein, 109 aa, Artificial Sequence
  Description of Artificial Sequence: Synthetic polypeptide
SYELTQPPSVSVSPGQTARITCSGNQLGHKFASWYQQKPGQSPVVVIYEDKKRPSGIPERFSGSNSGNTATLTISGTQAMDEADYYCQVWDVITDHYVFGTGTKVTVLG

SEQ ID NO: 3359 - protein, 108 aa, Artificial Sequence
  Description of Artificial Sequence: Synthetic polypeptide
DIQVTQSPSSLAASVGDRVTITCQASQDISNYLNWYQQRPGKAPKLLIYDASNLETGVPPRFSGDGSGTHFSFTITNVQPEDVGTYYCQQYDSLPLTFGQGTRLEIKR

SEQ ID NO: 3360 - protein, 108 aa, Artificial Sequence
  Description of Artificial Sequence: Synthetic polypeptide
DIQVTQSPSSLSASVGDRVTITCRASQPISTYVNWYQQKPGKAPKLLIYDASTLEIGVPSRISGSGSGTDFTFTISSLQPEDIATYYCQQYDNFPLTFGGGTKVDIKR

SEQ ID NO: 3361 - protein, 108 aa, Artificial Sequence
  Description of Artificial Sequence: Synthetic polypeptide
DIRVTQSPSSLSASVGDRVTITCQANEDISIYLNWYQQRPGKAPKLLIYDASNLETGVPSRFSGSGSGTDFTFTISSLQPEDFATYYCQQYHTYPFTFGGGTKVDIKR

SEQ ID NO: 3362 - protein, 106 aa, Artificial Sequence
  Description of Artificial Sequence: Synthetic polypeptide
SYELTQPPSVSVSPGQTASITCSGDKLGDKYACWYQQKPGQSPVLVIYQDSKRPSGIPKRFSGSNSGDTATLTISGTQAMDEADYYCQAWDSSTGVFGPGTKVTVL

SEQ ID NO: 3363 - protein, 108 aa, Artificial Sequence
  Description of Artificial Sequence: Synthetic polypeptide
DIVMTQTPSSLSASVGDRVTITCQASQDISDYLNWYQQKPGKAPKLLIYDASTLESGVPSRFSGSGSGTDFTLTISGLQPEDFATYYCQQSYSIPPTFGPGTRLEIKR

SEQ ID NO: 3364 - protein, 111 aa, Artificial Sequence
  Description of Artificial Sequence: Synthetic polypeptide
QSGLTQPPSVSAAPGQRVTISCTGSGSNIGAGYGVHWYQQLPATAPKILIYGDYNRPSGVPDRFSGSRSGTSASLTITGLQAEDEADYYCQSYDNSLRGVLFGGGTKLTVL

SEQ ID NO: 3365 - protein, 111 aa, Artificial Sequence
  Description of Artificial Sequence: Synthetic polypeptide
QPVLTQSPSVSASLGASVKVTCTLSSGHSAYAIAWHQQQPEKGPRYLMKVNSDGSHNKGDGVPDRFSGSSSGAERYLIISGLQSEDEADYYCQTWGPGIRVFGGGTKLTVL

SEQ ID NO: 3366 - protein, 107 aa, Artificial Sequence
  Description of Artificial Sequence: Synthetic polypeptide
DVVMTQSPDFQSVTPEDKVTITCRASQSIGSCLHWYQQKPDQSPKLLIKYASQSISGVPSRFSGSGSGTDFTLTINSLEAEDAATYYCHQSSSLPYTFGQGTKLEIK

SEQ ID NO: 3367 - protein, 108 aa, Artificial Sequence
  Description of Artificial Sequence: Synthetic polypeptide
SYELTQPPSVSVAPGQTARITCGGNNIGSKSVHWYQQKPGQAPVLVVYDDSDRPSGIPERFSGSNSGNTATLTISRVEAGDEADYYCQVWGSSSDHYVFGTGTKVTVL

SEQ ID NO: 3368 - protein, 109 aa, Artificial Sequence
  Description of Artificial Sequence: Synthetic polypeptide
QSALTQPRSVSGSPGQSVTISCTGTSSSVGDSIYVSWYQQHPGKAPKLMLYDVTKRPSGVPDRFSGSKSGNTASLTISGLQAEDEADYYCCSYAGTDTLFGGGTKVTVL

SEQ ID NO: 3369 - protein, 110 aa, Artificial Sequence
  Description of Artificial Sequence: Synthetic polypeptide
QSVLTQPPSASGTPGQRVTISCSGASSNVGSNRVNWYQQFPGMAPKLLIYSNNQRPSGVPDRFSGSKSGTSASLAISGLQSEDEADYYCAAWDDSLNGYVFGTGTKVTVL

SEQ ID NO: 3370 - protein, 108 aa, Artificial Sequence
  Description of Artificial Sequence: Synthetic polypeptide
SYELTQPPSVSVAPGQTARITCGGNNIGDISVHWYQQKSGQAPMLVVHDDSDRPSGIPERFSGSNSGSSATLTISRVEAGDEADYHCQVWDSGSGHHVFGTGTKVTVL

SEQ ID NO: 3371 - protein, 108 aa, Artificial Sequence
  Description of Artificial Sequence: Synthetic polypeptide
DIQLTQSPSSLSASVGDGVTITCQASQDISNYLNWYQQKPGKAPKLLIYDASNLETGVPSRFSGSGSGTFFTLTINNLQPEDFATYYCQQSGNTPWTFGQGTKVEINR

SEQ ID NO: 3372 - protein, 126 aa, Artificial Sequence
  Description of Artificial Sequence: Synthetic polypeptide
MDFQVQIFSFLLISASVSRGQIVLTQSPAILSASPGEKVTMTCSASSTVNYMHWYQQKSGTSPKIWIYDTSKLASGVPARFSGSGSWTSYSLTISSMEAEDAATYYCQQWNSNPPTFGAGTKLELK

SEQ ID NO: 3373 - protein, 131 aa, Artificial Sequence
  Description of Artificial Sequence: Synthetic polypeptide
MMSPAQFLFLLVLWIQETNGDVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPTFGVGTKLEIK

SEQ ID NO: 3374 - protein, 131 aa, Artificial Sequence
  Description of Artificial Sequence: Synthetic polypeptide
MMSPAQFLFLLVLWIQETNGDVVMTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPTFGGGTKLEIK

SEQ ID NO: 3375 - protein, 112 aa, Artificial Sequence; identical to SEQ ID NO: 3345
  Description of Artificial Sequence: Synthetic polypeptide

SEQ ID NO: 3376 - protein, 112 aa, Artificial Sequence; identical to SEQ ID NO: 3339
  Description of Artificial Sequence: Synthetic polypeptide

SEQ ID NO: 3377 - protein, 112 aa, Artificial Sequence; identical to SEQ ID NO: 3340
  Description of Artificial Sequence: Synthetic polypeptide

SEQ ID NO: 3378 - protein, 112 aa, Artificial Sequence; identical to SEQ ID NO: 3341
  Description of Artificial Sequence: Synthetic polypeptide

SEQ ID NO: 3379 - protein, 112 aa, Artificial Sequence [sequence omitted]

SEQ ID NO: 3380 - protein, 112 aa, Artificial Sequence; identical to SEQ ID NO: 3343
  Description of Artificial Sequence: Synthetic polypeptide

SEQ ID NO: 3381 - protein, 112 aa, Artificial Sequence; identical to SEQ ID NO: 3344
  Description of Artificial Sequence: Synthetic polypeptide

SEQ ID NO: 3382 - protein, 112 aa, Artificial Sequence; identical to SEQ ID NO: 3338
  Description of Artificial Sequence: Synthetic polypeptide

SEQ ID NO: 3383 - protein, 218 aa, Artificial Sequence; identical to SEQ ID NO: 3236
  Description of Artificial Sequence: Synthetic polypeptide

SEQ ID NO: 3384 - protein, 217 aa, Artificial Sequence; identical to SEQ ID NO: 3237
  Description of Artificial Sequence: Synthetic polypeptide

SEQ ID NO: 3385 - protein, 109 aa, Artificial Sequence
  Description of Artificial Sequence: Synthetic polypeptide
DIQDRVLAWYAASGSEDFTFGMTQSTITCYQQKSSLQGTDFATYYQGTKPSSLSASVGRASQGISSYPGKAPKLLISGVPSRFSGTLTISSLQPCQQHYTTPPVEIKRT

SEQ ID NO: 3386 - protein, 114 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCQQHYTTPPTFGQGTKVEIKRT

SEQ ID NO: 3387 - protein, 110 aa, Artificial Sequence
  Description of Artificial Sequence: Synthetic polypeptide
DIVLTQSPATLSLSPGERATLSCRASQSVSSSYLAWYQQKPGQAPRLLIYGASSRATGVPARFSGSGSGTDFTLTISSLEPEDFAVYYCQQHYTTPPTFGQGTKVEIKRT

SEQ ID NO: 3388 - protein, 115 aa, Artificial Sequence
  Description of Artificial Sequence: Synthetic polypeptide
DIVMTQSPDSLAVSLGERATINCRSSQSVLYSSNNKNYLAWYQQKPGQPPKLLIYWASTRESGVPDRFSGSGSGTDFTLTISSLQAEDVAVYYCQQHYTTPPTFGQGTKVEIKRT

SEQ ID NO: 3389 - protein, 109 aa, Artificial Sequence
  Description of Artificial Sequence: Synthetic polypeptide
QSVLTQPPSVSGAPGQRVTISCSGSSSNIGSNYVSWYQQLPGTAPKLLIYDNNQRPSGVPDRFSGSKSGTSASLAITGLQSEDEADYYCQQHYTTPPVFGGGTKLTVLG

SEQ ID NO: 3390 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCQQHYTTPPVFGGGTKLTVLG

SEQ ID NO: 3391 - protein, 107 aa, Artificial Sequence
  Description of Artificial Sequence: Synthetic polypeptide
SYELTQPPSVTARISCSGDASVAPGQLGDKYASWYQQKPGQAPVLVIYDDSDRPSGIPERFSGSNSGNTATLTISGTQAEDEADYYCQQHYTTPPVFGGGTKLTVLG

SEQ ID NO: 3392 - protein, 456 aa, Artificial Sequence
  Description of Artificial Sequence: Synthetic polypeptide
QVELVESGGGLVQPGGSLRLSCAASGFTFSSYAMSWVRQAPGKGLEWVSAINASGTRTYYADSVKGRFTISRDNSKNTLYLQMNSLRAEDTAVYYCARGKGNTHKPYGYVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3393 - protein, 456 aa, Artificial Sequence; identical to SEQ ID NO: 3392
  Description of Artificial Sequence: Synthetic polypeptide

SEQ ID NO: 3394 - protein, 442 aa, Artificial Sequence
  Description of Artificial Sequence: Synthetic polypeptide
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3395 - protein, 222 aa, Artificial Sequence
  Description of Artificial Sequence: Synthetic polypeptide
EVQLVESGGGLVQPGGSLRLSCAASGFTFLGYGIHWVRQAPGKGLEWVGWISPAGGSTDYADSVKGRFTISADTSKNTAYLQMNSLRAEDTAVYYCARGPFSPWVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3396 - protein, 439 aa, Artificial Sequence
  Description of Artificial Sequence: Synthetic polypeptide
EVQLVESGGGLVQPGGSLRLSCAASGFTFSSYGMSWVRQAPGKGLELVASINSNGGSTYYPDSVKGRFTISRDNAKNSLYLQMNSLRAEDTAVYYCASGDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3397 - protein, 439 aa, Artificial Sequence; identical to SEQ ID NO: 3396
  Description of Artificial Sequence: Synthetic polypeptide

SEQ ID NO: 3398 - protein, 458 aa, Artificial Sequence
  Description of Artificial Sequence: Synthetic polypeptide
MGRSWIFLFLLSGTAGVHSEVQLQQSGPELVKPGASVKISCKASGYTFTDYNMHWVKQSHGKRLEWIGYIYPHNGGTGYNQRFKSKATLTVDKSSSTAYMELRSLTSEDSAVYYCARPGTEAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 3399 - protein, 341 aa, Artificial Sequence
  Description of Artificial Sequence: Synthetic polypeptide
VHSEVQLQQSGPELVKPGASVKISCKASGYTFTDYNMHWVKRLEWIGYIYPHNGGTGYNQRKSKATLTVDKSSSTAYMELRSLTSEDSAVYYCARPGTEAYWGQGTLVTVSAAKTTPPSVYPLAPGSAAQTNSMVTLGCLVKGYFPEPVTVTWNSGSLSSGVHTFPAVLVTVPSSTWPPKPKDVLTITLTPKVTCVVVDISKDDPEVQFSWFVDDVEVHTAQTQPRRSVSELPIMHQDWLNGKEFKCRVNSAAFPAPIEKTISKTKGRPKAPQVYTIPPPKEQMAKDKVSLQWNGQPAENYKNTQPIMDTDGSYFVYSKLNVQKSNWEAGNTFTCSVLHEG

SEQ ID NO: 3400 - protein, 117 aa, Artificial Sequence
  Description of Artificial Sequence: Synthetic polypeptide
EVKLEESGGGLVQPGGSMKLSCAASGFTFSNAWMDWVRQSPEKGLEWVAEIRSKANNHATYYGESVKGRFTISRDDSKSSVYLQMNSLRAEDTGIYYCTATVRGGYWGQGTTLTVSS

SEQ ID NO: 3401 - protein, 460 aa, Artificial Sequence
  Description of Artificial Sequence: Synthetic polypeptide
MYLGLNYVFIVFLLNGVQSEVKLEESGGGLVQPGGSMKLSCAASGFTFSNAWMDWVRQSPEKGLEWVAEIRSKANNHATYYGESVKGRFTISRDDSKSSVYLQMNSLRAEDTGIYYCTATVRGGYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 3402 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWVAHIWWDDDKYYNPSLKSRLTISKDTSKNTVYLQMNSLRAEDTAVYYCARRTTTADYFAYWGQGTTVTVSS

SEQ ID NO: 3403 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWLAHIWWDDDKYYNPSLKSRFTISKDTSKNTVYLQMNSLRAEDTAVYYCARRTTTADYFAYWGQGTTVTVSS

SEQ ID NO: 3404 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWLAHIWWDDDKYYNPSLKSRLTISKDTSKNTLYLQMNSLRAEDTAVYYCARRTTTADYFAYWGQGTTVTVSS

SEQ ID NO: 3405 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWVAHIWWDDDKYYNPSLKSRLTISKDTSKNTVYLQMNSLRAEDTAVYYCARRTTTADYFAYWGQGTTVTVSS

SEQ ID NO: 3406 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWLAHIWWDDDKYYNPSLKSRFTISKDTSKNTVYLQMNSLRAEDTAVYYCARRTTTADYFAYWGQGTTVTVSS

SEQ ID NO: 3407 - protein, 121 aa, Artificial Sequence
  Description of Artificial Sequence: Synthetic polypeptide
QVQLVESGGGVVQPGRSLRLSCAFSGFTLSTSGMSVGWIRQAPGKGLEWLAHIWWDDDKYYNPSLKSRLTISKDTSKNTLYLQMNSLRAEDTAVYYCARRTTTADYFAYWGQGTTVTVSSV

SEQ ID NO: 3408 - protein, 121 aa, Artificial Sequence
  Description of Artificial Sequence: Synthetic polypeptide
QVQLVESGGGVVQPGRSLRLSCAFSGFSLSTSGMSVGWIRQAPGKGLEWVAHIWWDDDKYYNPSLKSRFTISKDTSKNTVYLQMNSLRAEDTAVYYCARRTTTADYFAYWGQGTTVTVSSV

SEQ ID NO: 3409 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWVAHIWWDDDKYYNPSLKSRLTISKDTSKNTLYLQMNSLRAEDTAVYYCARRTTTADYFAYWGQGTTVTVSS

SEQ ID NO: 3410 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWLAHIWWDDDKYYNPSLKSRFTISKDTSKNTLYLQMNSLRAEDTAVYYCARRTTTADYFAYWGQGTTVTVSS

SEQ ID NO: 3411 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWVAHIWWDDDKYYNPSLKSRFTISKDTSKNTVYLQMNSLRAEDTAVYYCARRTTTADYFAYWGQGTTVTVSS

SEQ ID NO: 3412 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWVAHIWWDDDKYYNPSLKSRLTISKDTSKNTLYLQMNSLRAEDTAVYYCARRTTTADYFAYWGQGTTVTVSS

SEQ ID NO: 3413 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWLAHIWWDDDKYYNPSLKSRFTISKDTSKNTLYLQMNSLRAEDTAVYYCARRTTTADYFAYWGQGTTVTVSS

SEQ ID NO: 3414 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWVAHIWWDDDKYYNPSLKSRFTISKDTSKNTLYLQMNSLRAEDTAVYYCARRTTTADYFAYWGQGTTVTVSS

SEQ ID NO: 3415 - protein, 120 aa, Artificial Sequence
  Description of Artificial Sequence: Synthetic polypeptide
QVQLVESGGGVVQPGRSLRLSCAFSGFTLSTSGMSVGWVRQAPGKGLEWLAHIWWDDDKYYNPSLKSRLTISKDTSKNTVYLQMNSLRAEDTAVYYCARRTTTADYFAYWGQGTTVTVSS

SEQ ID NO: 3416 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWLAHIWWDDDKYYNPSLKSRLTISKDNSKNTVYLQMNSLRAEDTAVYYCARRTTTADYFAYWGQGTTVTVSS

SEQ ID NO: 3417 - protein, 112 aa, Artificial Sequence
  Description of Artificial Sequence: Synthetic polypeptide
DVLMTQTPLSLPVSLGDQASISCRSSQNIIHSNGNTYLEWYLQKPGQSPKLLIYKVSNRFSGVPDRFSGSGSGTDFTLKIKKVEAEDLGIYYCFQGSHVPLTFGAGTKLELE

SEQ ID NO: 3418 - protein, 123 aa, Artificial Sequence
  Description of Artificial Sequence: Synthetic polypeptide
QATLKESGPGILQSSQTLSLTCSFSGFSLSTSGMGVSWIRQPSGKGLEWLAHIYWDDDKRYNPSLKSRLTISKDTSRKQVFLKITSVDPADTATYYCVRRPITPVLVDAMDYWGQGTSVTVSS

SEQ ID NO: 3419 - protein, 219 aa, Artificial Sequence
  Description of Artificial Sequence: Synthetic polypeptide
DVVMTQSPLSLPVTLGQPASISCKSSQSLLDSDGKTYLNWLQQRPGQSPRRLIYLVSKLDSGVPDRFSGSGSGTDFTLKISRVEAEDVGVYYCWQGTHFPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3420 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWVAHIWWDDDKYYNPSLKSRFTISRDNSKNTLYLQMNSLRAEDTAVYYCARRTTTADYFAYWGQGTTVTVSS

SEQ ID NO: 3421 - protein, 468 aa, Artificial Sequence
  Description of Artificial Sequence: Synthetic polypeptide
MNFGLSLIFLVLVLKGVQCEVQLVESGGGLVQPGGSLRLSCAGSGFTFSNYGMSWVRQAPGKGLEWVASIRSGGGRTYYSDNVKGRFTISRENAKNSLYLQMNSLRAEDTAVYYCVRYDHYSGSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3422 - protein, 441 aa, Artificial Sequence
  Description of Artificial Sequence: Synthetic polypeptide
EVQLQQSGPEVVKPGVSVKISCKGSGYTFTDYAMHWVKQSPGKSLEWIGVISTKYGKTNYNPSFQGQATMTVDKSSSTAYMELASLKASDSAIYYCARGDDGYSWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3423 - protein, 441 aa, Artificial Sequence
  Description of Artificial Sequence: Synthetic polypeptide
EVQLQQSGPEVVKPGVSVKISCKGSGYTFTDYAMHWVKQSPGKSLEWIGVISTKYGKTNYNPSFQGQATMTVDKSSSTAYMELASLKASDSAIYYCARGDEGYSWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3424 - protein, 448 aa, Artificial Sequence
  Description of Artificial Sequence: Synthetic polypeptide
EVQLVESGGGLVQPGGSLKLSCAASGFTFSSYGMSWVRQTPDKRLELVASINSNGGSTYYPDSVKGRFTISRDNAKNTLYLQMSSLKSEDTAMYYCASGDYWGQGSTLTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 3425 - protein, 442 aa, Artificial Sequence; identical to SEQ ID NO: 3394
  Description of Artificial Sequence: Synthetic polypeptide

SEQ ID NO: 3426 - protein, 445 aa, Artificial Sequence
  Description of Artificial Sequence: Synthetic polypeptide
EVQLVESGGGLVQPGGSLRLSCAASGFTFSDNGMAWVRQAPGKGLEWVSFISNLAYSIDYADTVTGRFTISRDNAKNSLYLQMNSLRAEDTAVYYCVSGTWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3427 - protein, 445 aa, Artificial Sequence
  Description of Artificial Sequence: Synthetic polypeptide
EVQLVESGGGLVQPGGSLRLSCAASGFTFSDNGMAWVRQAPGKGLEWISFISNLAYSIDYADTVTGRFTISRDNAKNSLYLQMNSLRAEDTAVYYCVSGTWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3428 - protein, 453 aa, Artificial Sequence
  Description of Artificial Sequence: Synthetic polypeptide
QVQLVESGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3429 - protein, 442 aa, Artificial Sequence
  Description of Artificial Sequence: Synthetic polypeptide
QVQLVQSGAEVKKPGASVKVSCKASGYYTEAYYIHWVRQAPGQGLEWMGRIDPATGNTKYAPRLQDRVTMTRDTSTSTVYMELSSLRSEDTAVYYCASLYSLPVYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 3430 - protein, 439 aa, Artificial Sequence; identical to SEQ ID NO: 3396
  Description of Artificial Sequence: Synthetic polypeptide

SEQ ID NO: 3431 - protein, 450 aa, Artificial Sequence
  Description of Artificial Sequence: Synthetic polypeptide
METGLRWLLLVAVLKGVQCQSVEESGGHLVTPGTPLTLTCTVSGIDLSTYAMGWVRQAPGKGLEWIGVITKSGNTYYASWAKGRFAISKTSTTVDLKITSPTTEDTATYFCGRYGIGVSYYDIWGPGTLVTVSSGQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPTCPPPELLGGPSVFIFPPKPKDTLMISRTPEVTCVVVDVSQDDPEVQFTWYINNEQVRTARPPLREQQFNSTIRVVSTLPIAHQDWLRGKEEKCKVHNKALPAPIEKTISKARGQPLEPKVYTMGPPREELSSRSVSLTCMINGFYPSDISVEWEKNGKAEDNYKTTPAVLDSDGSYFLYSKLSVPTSEWQRGDVFTCSVMHEALHNHYTQKS

SEQ ID NO: 3432 - protein, 179 aa, Artificial Sequence
  Description of Artificial Sequence: Synthetic polypeptide
MKYLLPTAAAGLLLLAAQPAMAMAEVQLQQSGAELARPGTSVNLSCKTSGYSFTGYGVSWVKQRIGQGLEWIGEIYPRSGNTYYNEKFKGKATLTADKSSNTAYMELRSLTSEDSAVYFCARWNWERDAMDYWGQGTSVTVSSAKTTPPSDYPLAGGGGSGGGGSGGGGSDIVMTQTPL

SEQ ID NO: 3433 - protein, 121 aa, Artificial Sequence
  Description of Artificial Sequence: Synthetic polypeptide
EVQLVESGGGLVQPGGSLKLSCAASGFNFQISAIHWVRQASGKGLEWVGRIRSKSHNYATLYAASLKGRFTLSRDDSRNTAYLQMSSLQTEDMAVYYCTVLSANYDTFDYWGQGTLVTVSS

SEQ ID NO: 3434 - protein, 441 aa, Artificial Sequence
  Description of Artificial Sequence: Synthetic polypeptide
QVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3435 - protein, 440 aa, Artificial Sequence
  Description of Artificial Sequence: Synthetic polypeptide
QVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRWSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3436 - protein, 416 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSSASTKGPSVFPLAPCSRSTSESTAALGCLVKDYFPEPVTVSWNSGALTSGVHTFPAVLQSSGLYSLSSVVTVPSSSLGTKTYTCNVDNKPSNTKVDKRVESKYGPPCPPCPAPEFLGGPSVFLFPPKPKDTLMISRTPEVICVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLIVDKSRWQEGNVESCSVMHEALHNHYTQKSLSLSLGK

SEQ ID NO: 3437 - protein, 446 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLFHQDWLNGKEYKCKVSNKALPAPIEKTISKAKGQPREPQVYTLPPSREEMTKNQVSLTCLVKGFYPSDIAVEWESNGQPENNYKTTPPVLDSDGSFELYSKLTVDKSRWQQGNVFSCSVMHEALHNHYTQKSLSLSPGK

SEQ ID NO: 3438 - protein, 445 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVICVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3439 - protein, 442 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGEYPSDIAVEWESNGQPENNYKTTPPVLDSDGSFFLYSRLTVDKSRWQEGNVFSCSVMHEALHNHYTQKSLSLSLGK

SEQ ID NO: 3440 - protein, 445 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVESCSVMHEALHNHYTQKSLSLSPGK

SEQ ID NO: 3441 - protein, 444 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3442 - protein, 117 aa, Artificial Sequence
  Description of Artificial Sequence: Synthetic polypeptide
EVQLVESGEDLVKPGGSLKLSCVASGFAFSSYGMSWVRQTPDMRLEWVATISSSGSRTYFPDSVKGRLTISRDNDKNILYLQMSSLRSEDTAMYYCTITWDGAMDYWGRGISVTVSS

SEQ ID NO: 3443 - protein, 112 aa, Artificial Sequence
  Description of Artificial Sequence: Synthetic polypeptide
DVLMTQTPLSLPVSLGDQASISCKSSQSIVHSNGNTYLEWYLQKPGQSPKLLVYKVSNRFSGVPDRFSGSGSGTDFTLKISRVEAEDLGTYYCFQGSLVPWAFGGGTKLEIK

SEQ ID NO: 3444 - protein, 110 aa, Artificial Sequence
  Description of Artificial Sequence: Synthetic polypeptide
APEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAK

SEQ ID NO: 3445 - protein, 106 aa, Artificial Sequence
  Description of Artificial Sequence: Synthetic polypeptide
GQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3446 - protein, 441 aa, Artificial Sequence; identical to SEQ ID NO: 3434
  Description of Artificial Sequence: Synthetic polypeptide

SEQ ID NO: 3447 - protein, 442 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 3448 - protein, 445 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3449 - protein, 445 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3450 - protein, 442 aa, Artificial Sequence; identical to SEQ ID NO: 3447
  Description of Artificial Sequence: Synthetic polypeptide

SEQ ID NO: 3451 - protein, 408 aa, Artificial Sequence
  Description of Artificial Sequence: Synthetic polypeptide
RQAPGQGLEWIGDINPNRGGTTYNQKFKGRVTITVDKSTSTAYMELSSLRSEDTAVYYCASYYAVGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3452 - protein, 445 aa, Artificial Sequence; identical to SEQ ID NO: 3449
  Description of Artificial Sequence: Synthetic polypeptide

SEQ ID NO: 3453 - protein, 123 aa, Artificial Sequence
  Description of Artificial Sequence: Synthetic polypeptide
EVKLLESGGGLVQPGGSLRLSCAASGFTFSTYTMSWVRQTPGKGLEWVAYISKGGGSTYYPDTVKGRFTISRDNSKNTLYLQMNSLRAEDTAVYYCAKGAMYGNDFFYPMDYWGQGTTVTVSS

SEQ ID NO: 3454 - protein, 123 aa, Artificial Sequence
  Description of Artificial Sequence: Synthetic polypeptide
EVKLMESGGGLVQPGGSLKLSCAASGFTFSTYTMSWARQTPEKRLEWVAYISKGGGSTYYPDTVKGRFTISRDNAKNTLYLQMSSLKSEDTALYYCARGAMYGNDFFYPMDYWGQQTSVTVSS

SEQ ID NO: 3455 - protein, 123 aa, Artificial Sequence
  Description of Artificial Sequence: Synthetic polypeptide
EVQLLESGGGLVQPGGSLRLSCAASGFTFSTYTMSWVRQTPGKRLEWVAYISKGGGSTYYPDTVKGRFTISRDNSKNTLYLQMNSLRAEDTAVYYCAKGAMYGNDFFYPMDYWGQGTTVTVSS

SEQ ID NO: 3456 - protein, 123 aa, Artificial Sequence
  Description of Artificial Sequence: Synthetic polypeptide
EVQLLESGGGLVQPGGSLRLSCAASGFTFSTYTMSWVRQAPGKRLEWVAYISKGGGSTYYPDTVKGRFTISRDNSKNTLYLQMNSLRAEDTAVYYCARGAMYGNDFFYPMDYWGQGTTVTVSS

SEQ ID NO: 3457 - protein, 123 aa, Artificial Sequence
  Description of Artificial Sequence: Synthetic polypeptide
EVKLLESGGGLVQPGGSLRLSCAASGFTFSTYTMSWVRQTPGKRLEWVAYISKGGGSTYYPDTVKGRFTISRDNSKNTLYLQMNSLRAEDTAVYYCARGAMYGNDFFYPMDYWGQGTTVTVSS

SEQ ID NO: 3458 - protein, 123 aa, Artificial Sequence
  Description of Artificial Sequence: Synthetic polypeptide
EVQLLESGGGLVQPGGSLRLSCAASGFTFSTYTMSWARQAPGKGLEWVAYISKGGGSTYYPDTVKGRFTISRDNSKNTLYLQMNSLRAEDSAVYYCARGAMFGNDFFFPMDRWGQGTLVTVSS

SEQ ID NO: 3459 - protein, 123 aa, Artificial Sequence
  Description of Artificial Sequence: Synthetic polypeptide
EVQLLESGGGLVQPGGSLRLSCAASGFTFSTYTMSWARQAPGKGLEWVAYISKGGGSTYYPDTVKGRFTISRDNSKNTLYLQMNSLRAEDSAVYYCARGAMYGNDFFYPMDYWGQGTLVTVSS

SEQ ID NO: 3460 - protein, 438 aa, Artificial Sequence
  Description of Artificial Sequence: Synthetic polypeptide
EVQLVESGGGLVQPGGSLRLSCAASGFTFSSYGMSWVRQAPGKGLELVASINSNGGSTYYPDSVKGRFTISRDNAKNSLYLQMNSLRAEDTAVYYCASGDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3461 - protein, 456 aa, Artificial Sequence; identical to SEQ ID NO: 3392
  Description of Artificial Sequence: Synthetic polypeptide

SEQ ID NO: 3462 - protein, 442 aa, Artificial Sequence; identical to SEQ ID NO: 3429
  Description of Artificial Sequence: Synthetic polypeptide

SEQ ID NO: 3463 - protein, 442 aa, Artificial Sequence; identical to SEQ ID NO: 3394
  Description of Artificial Sequence: Synthetic polypeptide

SEQ ID NO: 3464 - protein, 120 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARWGGDGFYAMDYWGQGTLVTVSS

SEQ ID NO: 3465 - protein, 120 aa, Artificial Sequence
  Description of Artificial Sequence: Synthetic polypeptide
QVQLVQSGAESVKVSCKASGVKKPGAYTFTSYYMHWVRQAPGQGLEWMGWINPNSGGTNYAQKFQGRVTMTRDTSISTAYMELSSLRSEDTAVYYCARWGGDGFYAMDYWGQGTLVTVSS

SEQ ID NO: 3466 - protein, 121 aa, Artificial Sequence
  Description of Artificial Sequence: Synthetic polypeptide
QVQLKESGPALVKPTQTLTLTCTFSGFSLSTSGVGVGWIRQPPGKALEWLALIDWDDDKYYSTSLKTRLTISKDTSKNQVVLTMTNMDPVDTATYYCARWGGDGFYAMDYWGQGTLVTVSS

SEQ ID NO: 3467 - protein, 120 aa, Artificial Sequence
  Description of Artificial Sequence: Synthetic polypeptide
EVQLVESGGGLVQPGGSLRLSCAASGFTFSSYAMSWVRQASAISGSGGPGKGLEWVSTYYADSVKGRFTISRDNSKNTLYLQMNSLRAEDTAVYYCARWGGDGFYAMDYWGQGTLVTVSS

SEQ ID NO: 3468 - protein, 119 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARWGGDGFYAMDYWGQGTLVTVSS

SEQ ID NO: 3469 - protein, 120 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSARWGGLKASDTAMYYCDGFYAMDYWGQGTLVTVSS

SEQ ID NO: 3470 - protein, 123 aa, Artificial Sequence
  Description of Artificial Sequence: Synthetic polypeptide
QVQLQQSGPGLVKPSQTLSLTCAISGDSVSSNSAAWNWIRQSPGRGLEWLGRTYYRSKWYNDYAVSVKSRITINPDTSKNQFSLQLNSVTPEDTAVYYCARWGGDGFYAMDYWGQGTLVTVSS

SEQ ID NO: 3471 - protein, 126 aa, Artificial Sequence
  Description of Artificial Sequence: Synthetic polypeptide
DVQLQESGGGSVQAGGSLRLSCVASGWTYSSNSLSMAWFRQAPGKEREGVATITSYVGRTYYADSVKGRFTISRDHAKSTVYLQIDSLKPEDTATYYCAAEYLGGSFLSTGAYKYWGQGTQVTVSS

SEQ ID NO: 3472 - protein, 129 aa, Artificial Sequence
  Description of Artificial Sequence: Synthetic polypeptide
DVQLQESGGGSVQAGGSLRLSCAASGYSYSYYIGWFRQAPGKEREGVAAIAIVNSGGGRTYYADSVKGRFTISQGNDKNTVYLQMNSLKPEDTAIYYCAARSLSWYSHPLLQPSQFNNWGQGTQVTVSS

SEQ ID NO: 3473 - protein, 128 aa, Artificial Sequence
  Description of Artificial Sequence: Synthetic polypeptide
DVQLQESGGGSVQAEGSLRLSCTASGYTYSLMGWFRQAPGKEREGVAVINSGVGTTYYADSVKGRFTISQDNAKSTVYLQMNSLKPEDTAIYYCAARRSWFTGMTTTQALDPDWFSYWGQGTQVTVSS

SEQ ID NO: 3474 - protein, 125 aa, Artificial Sequence
  Description of Artificial Sequence: Synthetic polypeptide
DVQLQESGGGSVQAGGSLRLSCAASGYTSEMNRFAWLRQAPGKDREVVAVIFPTARGAKFYSDSVNGRFTISQDTAKNTVYLQMNSLEPEDTAMYFCAASANAMTGFQPSGYTYWGQGTQVTVSS

SEQ ID NO: 3475 - protein, 129 aa, Artificial Sequence
  Description of Artificial Sequence: Synthetic polypeptide
QVQLQESGGGTVQAGGSLRLSCAASGYTYRSYCMGWFRQAPGKEREEVASINSDQGSTRYAASVKGRFTSSQDNANNTVTVYLQMNSLKPEDTAIYYCAANDGCAYRVYRGGAYGYNFWGQGTQVTVSS

SEQ ID NO: 3476 - protein, 129 aa, Artificial Sequence
  Description of Artificial Sequence: Synthetic polypeptide
DVQLQESGGGSVQAGGSLRLSCAASGYAFSSYYMGWFRQAPGREREEVTGITQIGGTTYYADSVKGRFTISRDNAKNTVYLQMDSLKPEDTAIYYCAKLRRPFYYPLLERPSEGDFDYWGQGTQVTVSS

SEQ ID NO: 3477 - protein, 126 aa, Artificial Sequence
  Description of Artificial Sequence: Synthetic polypeptide
QVQLQESGGGSVQAGGSLRLSCAASEYTDSTYYMAWFRQAPGKERGGVATLASRYDTTYYADSVKGRFTISQDRAKNTVYLQMNSLKPEDTGIYYCAASPRRPGFFPLDPSQYNYWGQGTQVTVSS

SEQ ID NO: 3478 - protein, 127 aa, Artificial Sequence
  Description of Artificial Sequence: Synthetic polypeptide
QVQLQESGGGSVQAGGSLRLSCAASRDILTLYYMGWFRQAPGKEREGVAAISSDIIFTSYANSVKGRFTISRDKDKNTVYLQMNSLKPEDTAIYYCAAASTWVPGFFPLFASQYNSWGQGTQVTVSS

SEQ ID NO: 3479 - protein, 127 aa, Artificial Sequence
  Description of Artificial Sequence: Synthetic polypeptide
QVQLQESGGGSVQAGGSLRLSCAASRDILTLYYMGWFRQAPGKEREGVAAISSDIIFTSYANSVKGRFTISRDEDKNTVYLQMNSLKPEDTAIYYCAAASTWVPGFFPLFASQYNSWGQGTQVTVSS

SEQ ID NO: 3480 - protein, 125 aa, Artificial Sequence
  Description of Artificial Sequence: Synthetic polypeptide
QVQLQESGGGSVQAGGSLRLSCAHSNTYPTYMGWFRQAPGKEREGVAAIYTGDGTTYYGDSVKGRFTISQDNAKNTVYLQMNSLKPEDTAIYYCAAALSRVPGFFPLFPSQYNYWGQGTQVTVSS

SEQ ID NO: 3481 - protein, 125 aa, Artificial Sequence; identical to SEQ ID NO: 3480
  Description of Artificial Sequence: Synthetic polypeptide

SEQ ID NO: 3482 - protein, 127 aa, Artificial Sequence
  Description of Artificial Sequence: Synthetic polypeptide
DVQLQESGGGSVQAGGSLRLSCAVSGFSYSPYYMGWFRQAPGKEREGVAAIRKGIGTTYYADSVKGRFTFSQDDAKNTMYLQMNSLKPEDTAIYFCAVGHYRAYATTSFDPRRYDYWGQGTQVTVSS

SEQ ID NO: 3483 - protein, 127 aa, Artificial Sequence
  Description of Artificial Sequence: Synthetic polypeptide
QVQLQESGGGSVQAGGSLRLSCAASGFTSSVYYISWFRQAPGKEREGVAAINSGGGITFYADSVKGRFTISQDNAKNTVYLQMNSLKPEDTAIYYCAAALSRVPGFFPLFPSQYNYWGQGTQVTVSS

SEQ ID NO: 3484 - protein, 115 aa, Artificial Sequence
  Description of Artificial Sequence: Synthetic polypeptide
QVQLQESGGGLVQPGGSLRLSCAASGFTFSNYWMYWVRQAPGKGLEWVSQINSGGGTTYSTDSVKGRFTISRDNAKNTLYLQMNSLKPEDTAMYYCATDSTGSHRGQGTQVTVSS

SEQ ID NO: 3485 - protein, 124 aa, Artificial Sequence
  Description of Artificial Sequence: Synthetic polypeptide
QVQLQESGGGSVQAGGFLRLSCAASGYTYSTCSMAWYRQAPGKERELVSSIRNDGSTAYADSVKGRFTISQDNAKNTVYLQMNSLKPEDTAMYYCNIRIGVGPGGTCSIYAPYWGEGTQVTVSS

SEQ ID NO: 3486 - protein, 127 aa, Artificial Sequence
  Description of Artificial Sequence: Synthetic polypeptide
QVQLQESGGGSVQAGGSLRLSCAASGISRSTYFMGWFRQAPGKEREGVAVINYGTTTPYYPDSVKGRFTVSRDSSKNTVYLRMNSLKPEDTAIYYCAAASTWVPGFFPLFASQYNSWGQGTQVTVSS

SEQ ID NO: 3487 - protein, 128 aa, Artificial Sequence
  Description of Artificial Sequence: Synthetic polypeptide
QVQLQESGGGSVQAGGSLRLSCAASGATASDYCMGWFRQAPGKEREGVAAISRGGMTYHVDSVRGRFTISRNNAQNTVYLQMNSLKPEDTATYSCAAVSCAGAWFANRALRESAFTYWGPGTQVTVSS

SEQ ID NO: 3488 - protein, 120 aa, Artificial Sequence
  Description of Artificial Sequence: Synthetic polypeptide
QVQLQESGGGLVQAGGSLRLSCAASGRIFDLRDMGWYRQVPGKQRELVAAITSGGTSNYADSVKGRFTISRDNAKNTVYLQMNSLKPEDTAVYYCNAKNFFSASGYFLYWGKGTQVTVSS

SEQ ID NO: 3489 - protein, 121 aa, Artificial Sequence
  Description of Artificial Sequence: Synthetic polypeptide
QVQLQESGGGLVQPGGSLRLSCAASGFTFETQYMTWVRQAPGKGPEYVSSINSGGTIKYYANSSVKGRFTISRDNAKNTLYLQMNNLRPEDTAIYYCQLGQWAGVGAASSRGQGTQVTVSS

SEQ ID NO: 3490 - protein, 122 aa, Artificial Sequence
  Description of Artificial Sequence: Synthetic polypeptide
QVQLQESGGGLVQPGGSLRLSCAASGFTFSTYWMYWVRQAPGKGLEWVSAISTEGGSTRYAGSVKGRFTISRDNAKSTLYLQMDSLKSEDTAVYYCSKGTGPFTDIRSTGSRGKGTQVTVSS

SEQ ID NO: 3491 - protein, 122 aa, Artificial Sequence
  Description of Artificial Sequence: Synthetic polypeptide
QVQLQESGGGLVQPGGSLRLSCAASGFTFSSYWMYWFRQAPGKGLERVSAINFGGDVTYYTDSVKGRFTISRDNAKNTLYLQMNSLKSEDTAVYYCTKGLSPYRDLESSGSRGQGTQVTVSS

SEQ ID NO: 3492 - protein, 125 aa, Artificial Sequence
  Description of Artificial Sequence: Synthetic polypeptide
DVQLQESGGGSVQAGGSLRLSCAVSGYTYNIYTMAWFRQAPGKEREGVAGIYSPGGTTYYADSVKGRFTISQDNAKNTVYLQMNSLAPEDTAIYYCAARGGLLSRVLKEAGYNAWGQGTQVTVSS

SEQ ID NO: 3493 - protein, 125 aa, Artificial Sequence
  Description of Artificial Sequence: Synthetic polypeptide
DVQLQESGGGSVQAGGSLRLSCAASGYTFTKYPMGWFRQAPGKECELVSSIISGGVTTYASSVKGRFTISRDNAKNTVYLQMNSLKPEDTAVYYCAAQYPYSSSWPRCPFRIGYWGQGTQVTVSS

SEQ ID NO: 3494 - protein, 123 aa, Artificial Sequence
  Description of Artificial Sequence: Synthetic polypeptide
DVQLQESGGGSVQAGGSLRLSCARSGGTVSIPYMAWFRQGPGKEREGVAAIYDGRAKTYAGSLQGRFTISQDNDKNTLYLQMNSLKPDDTAVYYCAAGNGGGNWLRPSEYNYWGKGTQVTVSS

SEQ ID NO: 3495 - protein, 121 aa, Artificial Sequence
  Description of Artificial Sequence: Synthetic polypeptide
DVQLQESGGGSVQAGGSLRLSCAASEYTYGYCSMGWYRQAPGKERELVSTITSDGSTSYVDSVKGRFTISQDNAKNTVYLQMNSLKPEDTAKYYCYTKTCANKLGAKFISWGQGTQVTVSS

SEQ ID NO: 3496 - protein, 127 aa, Artificial Sequence
  Description of Artificial Sequence: Synthetic polypeptide
DVQLQESGGGSVQPGGSLRLSCAASGYFYSRWYMGWFRQAPGKEREGVAAINSGGSITSYADSVKGRFTISQDNAKNTVYLQMNSLKPEDTAIYYCAAALSRVPGFFPLFPSQYNYWGQGTQVTVSS

SEQ ID NO: 3497 - protein, 129 aa, Artificial Sequence
  Description of Artificial Sequence: Synthetic polypeptide
DVQLQESGGGSAQAGGSLRLSCEVSGYTYSGYFMGWFRQAPGEEREGVAAIDTNGGRTWYADSVKGRFTISHDNAESTVYLQMNSLQPEDTAIYFCAARRPPGGSWYPPPLRKYSYNFWGQGTQVTVSS

SEQ ID NO: 3498 - protein, 128 aa, Artificial Sequence
  Description of Artificial Sequence: Synthetic polypeptide
DVQLQESGGGSVQAGGSLRLSCVASGFTYRRYFMGWFRQAPGKEREAVATMFSCGGTTYYADSVKGRFTATQDNAKNTVYLQMNNLKPEDTAIYYCAAASGCWYDGSPAARSVDVSFWGHGTQVTVSS

SEQ ID NO: 3499 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 3500 - protein, 98 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRV

SEQ ID NO: 3501 - protein, 221 aa, Artificial Sequence
  Description of Artificial Sequence: Synthetic polypeptide
EVQLQQSGAEVVRSGASVKLSCTASGFNIKDYYIHWVKQRPEKGLEWIGWIDPEIGDTEYVPKFQGKATMTADTSSNTAYLQLSSLTSEDTAVYYCNAGHDYDRGRFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRD

SEQ ID NO: 3502 - protein, 451 aa, Artificial Sequence
  Description of Artificial Sequence: Synthetic polypeptide
EVQLVESGGGLVQPGGSLKLSCAASGFNFNISAIHWVRQASGKGLEWVGRIRSKSHNYATLYAASLKGRFTLSRDDSRNTAYLQMSSLQTEDMAVYYCTVLSANYDTFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 3503 - protein, 451 aa, Artificial Sequence
  Description of Artificial Sequence: Synthetic polypeptide
EVQLVESGGGLVQPGGSLKLSCAASGFNFQISAIHWVRQASGKGLEWVGRIRSKSHNYATLYAASLKGRFTLSRDDSRNTAYLQMSSLQTEDMAVYYCTVLSANYDTFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 3504 - protein, 142 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRALLLRYPNAMDYWGQGTSVTVSS

SEQ ID NO: 3505 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSEVRRGAMDYWGQGTSVTVSS

SEQ ID NO: 3506 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSAYYGNHFDYWGQGTTLTVSS

SEQ ID NO: 3507 - protein, 136 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARLYGNIAYWGQGTLVTVSA

SEQ ID NO: 3508 - protein, 139 aa, Artificial Sequence
  Description of Artificial Sequence: Synthetic polypeptide
MGRLTSSFLLLIVPAYVLSQVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIGRTTGNFDVWGAGTTVTVSS

SEQ ID NO: 3509 - protein, 104 aa, Artificial Sequence
  Description of Artificial Sequence: Synthetic polypeptide
MKPGASVKISCKATGYTFSSYWIEWVKQRPGHGLEWIGDILPGIGTTNYNEKFKGKATFTADTSSNTAYMQLSSLTSEDSAVYYCASTGPVDYWGQGTTLRVSS

SEQ ID NO: 3510 - protein, 139 aa, Artificial Sequence; identical to SEQ ID NO: 3508
  Description of Artificial Sequence: Synthetic polypeptide

SEQ ID NO: 3511 - protein, 136 aa, Artificial Sequence
  Description of Artificial Sequence: Synthetic polypeptide
MNRLASSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGNGFAYWGQGTLVTVSA

SEQ ID NO: 3512 - protein, 143 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRANYYGYGMDAMDYWGQGTSVTVSS

SEQ ID NO: 3513 - protein, 134 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDGTMDYWGQGTSVTVSS

SEQ ID NO: 3514 - protein, 137 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARGITTGFAYWGQGTLVTVSA

SEQ ID NO: 3515 - protein, 136 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKSLEWLAHIYWDDDKRYNPSLKSRLTISKDTSRNQVFLKITSVDTADTATYYCARLRQGFAYWGQGTLVTVSA

SEQ ID NO: 3516 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRWGEGAMDYWGQGTSVTVSS

SEQ ID NO: 3517 - protein, 141 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRRQLGLRDAMDYWGQGTSVTVSS

SEQ ID NO: 3518 - protein, 139 aa, Artificial Sequence; identical to SEQ ID NO: 3508
  Description of Artificial Sequence: Synthetic polypeptide

SEQ ID NO: 3519 - protein, 137 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGYYALSYWGQGTLVTVSA

SEQ ID NO: 3520 - protein, 139 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLKKDYFDYWGQGTTLTVSS

SEQ ID NO: 3521 - protein, 140 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRASRGTDAMDYWGQGTSVTVSS

SEQ ID NO: 3522 - protein, 137 aa, Artificial Sequence
  Description of Artificial Sequence: Synthetic polypeptide
MRVLILLCLFTAFPGILSDVQLQESGPDLVKPSQSLSLTCTVTGYSITSGYSWHWIRQFPGNKLEWMGYIHYSGSTNYNPSLKSRISITRDTSKNQFFLQLNSVTTEDTATYYCARYLYYYGSSYEWGQGTTLTVSS

SEQ ID NO: 3523 - protein, 141 aa, Artificial Sequence; identical to SEQ ID NO: 3517
  Description of Artificial Sequence: Synthetic polypeptide

SEQ ID NO: 3524 - protein, 140 aa, Artificial Sequence
  Description of Artificial Sequence: Synthetic polypeptide
MDRLTSSFLLLIAPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRNLYRYDLFDYWGQGTTLTVSS

SEQ ID NO: 3525 - protein, 139 aa, Artificial Sequence; identical to SEQ ID NO: 3520
  Description of Artificial Sequence: Synthetic polypeptide

SEQ ID NO: 3526 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGYRYDEGFAYWGQGTLVTVSA

SEQ ID NO: 3527 - protein, 134 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSNLLDYWGQGTTLTVSS

SEQ ID NO: 3528 - protein, 136 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGSSFAYWGQGTLVTVSA

SEQ ID NO: 3529 - protein, 137 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKHYNPSLKSRLTISKDTSSNQLFLKITSVDTADTATYYCARYVYDSFAYWGQGTLVTVSA

SEQ ID NO: 3530 - protein, 141 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRTTARARDYFDYWGQGTTLTVSS

SEQ ID NO: 3531 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYGRGGAMDYWGQGTSVTVSS

SEQ ID NO: 3532 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGYRYLFDYWGQGTTLTVSS

SEQ ID NO: 3533 - protein, 139 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRALWYPWFAYWGQGTLVTVSA

SEQ ID NO: 3534 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSARSYGAMDYWGQGTSVTVSS

SEQ ID NO: 3535 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGNYAMDYWGQGTSVTVSS

SEQ ID NO: 3536 - protein, 134 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGNMDYWGQGTSVTVSS

SEQ ID NO: 3537 - protein, 137 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRRGYGYDYWGQGTTLTVSS

SEQ ID NO: 3538 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSRFGMYWVRQAPEKGLEWVAYISSGSSTIYYADIVKGRFTISRDNPKNTLFLQMTSLRSEDTAMYYCARRGYYEAMDYWGQGTSVTVSS

SEQ ID NO: 3539 - protein, 140 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGNYLRYYAMDYWGQGTSVTVSS

SEQ ID NO: 3540 - protein, 140 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLLRRDAMDYWGQGTSVTVSS

SEQ ID NO: 3541 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARAPTMITGGFAYWGQGTLVTVSA

SEQ ID NO: 3542 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYHYAMDYWGQGTSVTVSS

SEQ ID NO: 3543 - protein, 134 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGDFDYWGQGTTLTVSS

SEQ ID NO: 3544 - protein, 136 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRAGGFAYWGQGTLVTVSA

SEQ ID NO: 3545 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYGSSYAMDYWGQGTSVTVSS

SEQ ID NO: 3546 - protein, 139 aa, Artificial Sequence
  Description of Artificial Sequence: Synthetic polypeptide
MAVLGLLFCLVTFPSCVLSQVQLKQSGPGLVQPSQSLSITCTVSGFSLTSYGVHWVRQSPGKGLEWLGVIWSGGSTDYNAAFISRLSISKDNSKSQVFFKMNSLQANDTAIYYCARKAYYRYGYAMDYWGQGTSVTVSS

SEQ ID NO: 3547 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGGNYLMDYWGQGTSVTVSS

SEQ ID NO: 3548 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGTTATIDYWGQGTTLTVSS

SEQ ID NO: 3549 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARFITTRGAMDYWGQGTSVTVSS

SEQ ID NO: 3550 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRHWNYAMDYWGQGTSVTVSS

SEQ ID NO: 3551 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDETTATFAYWGQGTLVTVSA

SEQ ID NO: 3552 - protein, 141 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYGNLDYFDYWGQGTTLTVSS

SEQ ID NO: 3553 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYVDTVKGRFTISRDNPKNTLFLQMTSLRSEDTAMYYCATVWSGAMDYWGQGTSVTVSS

SEQ ID NO: 3554 - protein, 98 aa, Artificial Sequence
  Description of Artificial Sequence: Synthetic polypeptide
TCTVSGFSLTSYGVHWVRQSPGKGLEWLGVIWSGGSTDYNAAFISRLSISKDNSKSQVFFKMNSLQANDTAIYYCARKTSPEGGFAYWGQGTLVTVSA

SEQ ID NO: 3555 - protein, 117 aa, Artificial Sequence
  Description of Artificial Sequence: Synthetic polypeptide
DVQLVESGGGLVQPGGSRKLSCAASGFTFSSFGMHWVRQAPEKGLEWVAYISSGSSTIYYADTLKGRFTISRDNPKNTLFLQMTSLRSEDTAMYYCARYGNYAMDYWGQGTSVTVSS

SEQ ID NO: 3556 - protein, 140 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTFYYADTVKGRFTISRDNPKNTLFLQMTSLRSEDTAMYYCARDGYGRGGYAMDYWGQGTSVTVSS

SEQ ID NO: 3557 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRGYYEAMDYWGQGTSVTVSS

SEQ ID NO: 3558 - protein, 137 aa, Artificial Sequence
  Description of Artificial Sequence: Synthetic polypeptide
MGRLTSSFLLLIVPAYVLSQVTLKESGPGILQPSQTLSLTCSFSGFSLSTSGMSVGWIRQPSGKGLEWLAHIWWDDDKRYNPALKSRLTISKDTSSNQVFLKIASVDTADTATYYCARYSSRAMDYWGQGTSVTVSS

SEQ ID NO: 3559 - protein, 128 aa, Artificial Sequence
  Description of Artificial Sequence: Synthetic polypeptide
MAVVTGVNSEVQLQQSGAELVKPGASVKLSCTASGFNIKDTYIHWVKQRPEQGLEWIGRIDPANGNTKYDPKFQGKATITADTSSITACLQLSSLTSEDTAVYYCARRIYGSGLFAYWGQGTLVTVSA

SEQ ID NO: 3560 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGTGTGAMDYWGQGTSVTVSS

SEQ ID NO: 3561 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYYLYYAMDYWGQGTSVTVSS

SEQ ID NO: 3562 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 3563 - protein, 140 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYDYDYFDYWGQGTTLTVSS

SEQ ID NO: 3564 - protein, 109 aa, Artificial Sequence; identical to SEQ ID NO: 3562
  Description of Artificial Sequence: Synthetic polypeptide

SEQ ID NO: 3565 - protein, 109 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPFTFGSGTKLEIK

SEQ ID NO: 3566 - protein, 93 aa, Artificial Sequence
  Description of Artificial Sequence: Synthetic polypeptide
MSCKSSQSLLYSSNQKNYLAWYQQKPGQSPKLLIYWASTRESGVPDRFTGSGSGTDFTLTISSVKAEDLAVYYCQQYYSYPWTFGGGTKLEIK

SEQ ID NO: 3567 - protein, 109 aa, Artificial Sequence; identical to SEQ ID NO: 3562
  Description of Artificial Sequence: Synthetic polypeptide

SEQ ID NO: 3568 - protein, 109 aa, Artificial Sequence; identical to SEQ ID NO: 3562
  Description of Artificial Sequence: Synthetic polypeptide

SEQ ID NO: 3569 - protein, 109 aa, Artificial Sequence; identical to SEQ ID NO: 3562
  Description of Artificial Sequence: Synthetic polypeptide

SEQ ID NO: 3570 - protein, 134 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSELLAYWGQGTLVTVSA

SEQ ID NO: 3571 - protein, 140 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGLRLRDAMDYWGQGTSVTVSS

SEQ ID NO: 3572 - protein, 138 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCAPLLRLGYFDVWGAGTTVTVSS

SEQ ID NO: 3573 - protein, 137 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRARTGLDYWGQGTSVTVSS

SEQ ID NO: 3574 - protein, 132 aa, Artificial Sequence
  Description of Artificial Sequence: Synthetic polypeptide
MGWSYIILFLVATATDVHSQVQLQQPGAELVKPGASVKLSCKASGYTFTSYWMHWVKQRPGQGLEWIGEINPSNGRTNYNEKFKSKATLTVDKSSSTAYMQLSSLTSEDSAVYYCARYDAYWGQGTLVTVSA

SEQ ID NO: 3575 - protein, 83 aa, Artificial Sequence
  Description of Artificial Sequence: Synthetic polypeptide
IRQPSGKGLEWLAHIWWDDDKYYNPSLKSQLTISKDTSRNQVFLKITSVDTADTATYYCARGITTRYYTMDYWGQGTSVTVSS

SEQ ID NO: 3576 - protein, 138 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARSPRGTSFAYWGQGTLVTVSA

SEQ ID NO: 3577 - protein, 135 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYAMDYWGQGTSVTVSS

SEQ ID NO: 3578 - protein, 140 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRGLRRGDYFDYWGQGTTLTVSS

SEQ ID NO: 3579 - protein, 136 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARYYYAMDYWGQGTSVTVSS

SEQ ID NO: 3580 - protein, 135 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCASYGNYGAYWGQGTLVTVSA

SEQ ID NO: 3581 - protein, 141 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRSMITTNDYFDYWGQGTTLTVSS

SEQ ID NO: 3582 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGYYAMDYWGQGTSVTVSS

SEQ ID NO: 3583 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLGTGTGAMDYWGQGTSVTVSS

SEQ ID NO: 3584 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCTRSDYGNSFAYWGQGTLVTVSA

SEQ ID NO: 3585 - protein, 138 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARLWYDGGPAYWGQGTLVTVSA

SEQ ID NO: 3586 - protein, 137 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARYGYDAMDYWGQGTSVTVSS

SEQ ID NO: 3587 - protein, 140 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCVRRGLYDYDRFAYWGQGTLVTVSA

SEQ ID NO: 3588 - protein, 137 aa, Artificial Sequence
  Description of Artificial Sequence: Synthetic polypeptide
MAVLGLLLCLVTFPSCVLSQVQLKESGPGLVAPSQSLSITCTISGFSLTSYGVHWVRQPPGKGLEWLVVIWSDGSTTYNSALKSRLSISKDNSKSQLFLKMNSLQTDDTAMYYCARHSYRYGLMDYWGQGTSVTVSS

SEQ ID NO: 3589 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAIPRTGTGAMDYWGQGTSVTVSS

SEQ ID NO: 3590 - protein, 252 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDYDKRYNPSLKSRLTISKDTSNNQVFLKITSVDTADTATYYCARRKVTGTLGLDAMDYWGQGTSVTVSSMTQTPLSLPVSLGDQASISCRSSQSIVHSNGNTYLEWYLQKSGQSPKLLIYKVSNRFSGVPDRFSGSGSGTDFTLKISRVEAEDLGVYYCFQGSLVPPTFGAGTKLELK

SEQ ID NO: 3591 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIK

SEQ ID NO: 3592 - protein, 109 aa, Artificial Sequence; identical to SEQ ID NO: 3562
  Description of Artificial Sequence: Synthetic polypeptide

SEQ ID NO: 3593 - protein, 109 aa, Artificial Sequence; identical to SEQ ID NO: 3591
  Description of Artificial Sequence: Synthetic polypeptide

SEQ ID NO: 3594 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARRGIYGYYAMDYWGQGTSVTVSS

SEQ ID NO: 3595 - protein, 140 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARAGGYSLSYAMDYWGQGTSVTVSS

SEQ ID NO: 3596 - protein, 138 aa, Artificial Sequence; identical to SEQ ID NO: 3585
  Description of Artificial Sequence: Synthetic polypeptide

SEQ ID NO: 3597 - protein, 140 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARKGTYYRYDAFDYWGQGTTLTVSS

SEQ ID NO: 3598 - protein, 134 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAREGHFDYWGQGTTLTVSS

SEQ ID NO: 3599 - protein, 140 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARGITTRYYTMDYWGQGTSVTVSS

SEQ ID NO: 3600 - protein, 131 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSTTIYYADTVKGRFTISRDNPKNTLFLQMTSLRSEDTAMYYCGGFAYWGQGTLVTVSA

SEQ ID NO: 3601 - protein, 139 aa, Artificial Sequence
  Description of Artificial Sequence: Synthetic polypeptide
MNFGLSLIFLALILKGVQCEVQLVESGGDLVKPGGSLKLSCAASGFTFSSYGMSWVRQTPDKRLDWVATISSGGSYTYYPDSVKGRFTISRDNAKNTLYLQMSSLKSEDTAMYYCARSTMIATGTFAYWGQGTLVTVSA

SEQ ID NO: 3602 - protein, 143 aa, Artificial Sequence
  Description of Artificial Sequence: Synthetic polypeptide
MNLGLSLIFLVLVLKGVQCEVKLVESGGGLVQPGGSLKLSCATSGFTFSDYYMYWVRQTPEKRLEWVAYISNGGGSTYYPDTVKGRFTISRDNAKNTLYLQMSRLKSEDTAMYYCARGTSYGSGLHYYAMDYWGQGTSVTVSS

SEQ ID NO: 3603 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDGNYVGWFAYWGQGTLVTVSA

SEQ ID NO: 3604 - protein, 109 aa, Artificial Sequence; identical to SEQ ID NO: 3562
  Description of Artificial Sequence: Synthetic polypeptide

SEQ ID NO: 3605 - protein, 140 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGYRYSYYAMDYWGQGTSVTVSS

SEQ ID NO: 3606 - protein, 92 aa, Artificial Sequence
  Description of Artificial Sequence: Synthetic polypeptide
MSCKSSQSLLNSGNQKNYLTWYQQKPGQPPKLLIYWASTRESGVPDRFTGSGSGTDFTLTISSVQAEDLAVYYCQNDYSYPTFGGGTKLEIK

SEQ ID NO: 3607 - protein, 109 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVFFCSQSTHVPLTFGAGTKLELK

SEQ ID NO: 3608 - protein, 109 aa, Artificial Sequence; identical to SEQ ID NO: 3562
  Description of Artificial Sequence: Synthetic polypeptide

SEQ ID NO: 3609 - protein, 109 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 3610 - protein, 109 aa, Artificial Sequence; identical to SEQ ID NO: 3562
  Description of Artificial Sequence: Synthetic polypeptide

SEQ ID NO: 3611 - protein, 109 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 3612 - protein, 136 aa, Artificial Sequence; identical to SEQ ID NO: 3528
  Description of Artificial Sequence: Synthetic polypeptide

SEQ ID NO: 3613 - protein, 109 aa, Artificial Sequence; identical to SEQ ID NO: 3591
  Description of Artificial Sequence: Synthetic polypeptide

SEQ ID NO: 3614 - protein, 109 aa, Artificial Sequence; identical to SEQ ID NO: 3611
  Description of Artificial Sequence: Synthetic polypeptide

SEQ ID NO: 3615 - protein, 109 aa, Artificial Sequence; identical to SEQ ID NO: 3562
  Description of Artificial Sequence: Synthetic polypeptide

SEQ ID NO: 3616 - protein, 99 aa, Artificial Sequence
  Description of Artificial Sequence: Synthetic polypeptide
MSCKASGYTFTSYWMHWVKQRPGQGLEWIGYINPSTGYTEYNQKFKDKATLTADKSSSTAYMQLSSLTSEDSAVYYCARWDGRGYFDYWGQGTTLTVSS

SEQ ID NO: 3617 - protein, 109 aa, Artificial Sequence; identical to SEQ ID NO: 3611
  Description of Artificial Sequence: Synthetic polypeptide

SEQ ID NO: 3618 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 3619 - protein, 109 aa, Artificial Sequence; identical to SEQ ID NO: 3591
  Description of Artificial Sequence: Synthetic polypeptide

SEQ ID NO: 3620 - protein, 109 aa, Artificial Sequence; identical to SEQ ID NO: 3591
  Description of Artificial Sequence: Synthetic polypeptide

SEQ ID NO: 3621 - protein, 109 aa, Artificial Sequence; identical to SEQ ID NO: 3562
  Description of Artificial Sequence: Synthetic polypeptide

SEQ ID NO: 3622 - protein, 128 aa, Artificial Sequence
  Description of Artificial Sequence: Synthetic polypeptide
MVFTPHILGLLLFWISASTGDILLTQSPATLSVTPGETVSLSCRASQSIYKNLHWYQQKSHRSPRLLIKYASDSISGIPSRFTGSGSGTDYTLSINSVKPEDEGIYYCLQGYSTPMYTFGGGTKLEIK

SEQ ID NO: 3623 - protein, 109 aa, Artificial Sequence; identical to SEQ ID NO: 3611
  Description of Artificial Sequence: Synthetic polypeptide

SEQ ID NO: 3624 - protein, 142 aa, Artificial Sequence
  Description of Artificial Sequence: Synthetic polypeptide
MDRLTSSFLLLIVPAYVLSQVTLKESGPGILQPSQTHSLTCSFSGFSLSTSGMGVSWIRQPSGKGLEWLAHIYWDDDKRYNPSLKSRLTISKDTSRNQVFLKITSVDTADTATYYCARKGVYYDYDVGFAYWGQGTLVTVSA

SEQ ID NO: 3625 - protein, 109 aa, Artificial Sequence; identical to SEQ ID NO: 3562
  Description of Artificial Sequence: Synthetic polypeptide

SEQ ID NO: 3626 - protein, 109 aa, Artificial Sequence; identical to SEQ ID NO: 3609
  Description of Artificial Sequence: Synthetic polypeptide

SEQ ID NO: 3627 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGTLYYYAMDYWGQGTSVTVSS

SEQ ID NO: 3628 - protein, 109 aa, Artificial Sequence; identical to SEQ ID NO: 3562
  Description of Artificial Sequence: Synthetic polypeptide

SEQ ID NO: 3629 - protein, 109 aa, Artificial Sequence; identical to SEQ ID NO: 3565
  Description of Artificial Sequence: Synthetic polypeptide

SEQ ID NO: 3630 - protein, 121 aa, Artificial Sequence
  Description of Artificial Sequence: Synthetic polypeptide
MFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGSGTKLEIK

SEQ ID NO: 3631 - protein, 109 aa, Artificial Sequence; identical to SEQ ID NO: 3611
  Description of Artificial Sequence: Synthetic polypeptide

SEQ ID NO: 3632 - protein, 109 aa, Artificial Sequence; identical to SEQ ID NO: 3591
  Description of Artificial Sequence: Synthetic polypeptide

SEQ ID NO: 3633 - protein, 109 aa, Artificial Sequence; identical to SEQ ID NO: 3591
  Description of Artificial Sequence: Synthetic polypeptide

SEQ ID NO: 3634 - protein, 109 aa, Artificial Sequence; identical to SEQ ID NO: 3562
  Description of Artificial Sequence: Synthetic polypeptide

SEQ ID NO: 3635 - protein, 112 aa, Artificial Sequence
  Description of Artificial Sequence: Synthetic polypeptide
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLEIK

SEQ ID NO: 3636 - protein, 141 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRALYYYGDYFDYWGQGTTLTVSS

SEQ ID NO: 3637 - protein, 119 aa, Artificial Sequence
  Description of Artificial Sequence: Synthetic polypeptide
QVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYYGSSPFDYWGQGTTLTVSS

SEQ ID NO: 3638 - protein, 138 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARGMITTAFAYWGQGTLVTVSA

SEQ ID NO: 3639 - protein, 140 aa, Artificial Sequence
  Description of Artificial Sequence: Synthetic polypeptide
MDRLTSSFLLLIVPAYILSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRGMITTDAMDYWGQGTSVTVSS

SEQ ID NO: 3640 - protein, 136 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYGRGFAYWGQGTLVTVSA

SEQ ID NO: 3641 - protein, 136 aa, Artificial Sequence
  Description of Artificial Sequence: Synthetic polypeptide
MNFVLSLIFLALILKGVQCEVQLVESGGGLVKPGGSLKLSCAASGFTFSSYAMSWVRQTPEKRLEWVATISSGGSYTYYPDSVKGRFTISRDNAKNTLYLQMSSLRSEDTAMYYCARQNWDGFAYWGQGTLVTVSA

SEQ ID NO: 3642 - protein, 115 aa, Artificial Sequence
  Description of Artificial Sequence: Synthetic polypeptide
DVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGNYPDYWGQGTTLTVSS

SEQ ID NO: 3643 - protein, 140 aa, Artificial Sequence
  Description of Artificial Sequence: Synthetic polypeptide
MDRLTSSFLLLIVPAYVLSQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCTRRALYDYDAMDYWGQGTSVTVSS

SEQ ID NO: 3644 - protein, 138 aa, Artificial Sequence; identical to SEQ ID NO: 3506
  Description of Artificial Sequence: Synthetic polypeptide

SEQ ID NO: 3645 - protein, 138 aa, Artificial Sequence; identical to SEQ ID NO: 3526
  Description of Artificial Sequence: Synthetic polypeptide

SEQ ID NO: 3646 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARTGTGAMDYWGQGTSVTVSS

SEQ ID NO: 3647 - protein, 138 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARYYGSSPFDYWGQGTTLTVSS

SEQ ID NO: 3648 - protein, 139 aa, Artificial Sequence; identical to SEQ ID NO: 3520
  Description of Artificial Sequence: Synthetic polypeptide

SEQ ID NO: 3649 - protein, 112 aa, Artificial Sequence
  Description of Artificial Sequence: Synthetic polypeptide
EVQLVESGGGLVQPGGSLRLSCAASGFTFSSYGMSWVRQAPGKGLELVASINSNGGSTYYPDSVKGRFTISRDNAKNTLYLQMNSLRAEDTAVYYCASGDYWGQGTLVTVSS

SEQ ID NO: 3650 - protein, 112 aa, Artificial Sequence
  Description of Artificial Sequence: Synthetic polypeptide
EVQLVESGGGLVQPGGSLRLSCAASGFTFSSYGMSWVRQAPGKGLEWVASINSNGGSTYYPDSVKGRFTISRDNAKNTLYLQMNSLRAEDTAVYYCASGDYWGQGTLVTVSS

SEQ ID NO: 3651 - protein, 112 aa, Artificial Sequence; identical to SEQ ID NO: 3649
  Description of Artificial Sequence: Synthetic polypeptide

SEQ ID NO: 3652 - protein, 131 aa, Artificial Sequence
  Description of Artificial Sequence: Synthetic polypeptide
MEFGLSWLFLVAILKGVQCEVQLVESGGGLVQPGGSLRLSCAASGFTFSSYGMSWVRQAPGKGLEWVASINSNGGSTYYPDSVKGRFTISRDNAKNTLYLQMNSLRAEDTAVYYCASGDYWGQGTLVTVSS

SEQ ID NO: 3653 - protein, 131 aa, Artificial Sequence
  Description of Artificial Sequence: Synthetic polypeptide
MEFGLSWLFLVAILKGVQCEVQLVESGGGLVQPGGSLRLSCAASGFTFSSYGMSWVRQAPGKGLELVASINSNGGSTYYPDSVKGRFTISRDNAKNTLYLQMNSLRAEDTAVYYCASGDYWGQGTLVTVSS

SEQ ID NO: 3654 - protein, 120 aa, Artificial Sequence
  Description of Artificial Sequence: Synthetic polypeptide
EVQLVQSGAEVKKPGASVKVSCKASGYTFTTFYIHWVRQAPGQGLEWIGMIGPGSGNTYYNEMFKDKATLTVDTSTSTAYMELSSLRSEDTAVYYCARAKSARAAWFAYWGQGTLVTVSS

SEQ ID NO: 3655 - protein, 118 aa, Artificial Sequence
  Description of Artificial Sequence: Synthetic polypeptide
EVKLVESGGGLVKPGGSLRLSCAASGFTFSSYAMSWVRQAPGKGLEWVASIHNRGTIFYLDSVKGRFTISRDNVRNTLYLQMNSLRAEDTAVYYCTRGRSNSYAMDYWGQGTSVTVSS

SEQ ID NO: 3656 - protein, 123 aa, Artificial Sequence
  Description of Artificial Sequence: Synthetic polypeptide
QVTLKESGPGLLKPTQTLTLTCTLSGFSLSTSGMGVGWFRQPPGKGLEWLAHIWWDDDKSYNPSLKSRLTISKDTSKNQVVLTITNVDPVDTATYYCARRQLGTRGTDAMDYWGQGTTVTVSS

SEQ ID NO: 3657 - protein, 433 aa, Artificial Sequence
  Description of Artificial Sequence: Synthetic polypeptide
QVTLKESGPGLLKPTQTLTLTCTLSGFSLSTSGMGVGWFRQPPGKGLEWLAHIWWDDDKSYNPSLKSRLTISKDTSKNQVVLTITNVDPVDTATYYCARRQLGTRGTDAMDYWGQGTTVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTFRVVSVLTVLHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKALHNHYTQKSLSLSPGK

SEQ ID NO: 3658 - protein, 112 aa, Artificial Sequence
  Description of Artificial Sequence: Synthetic polypeptide
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSS

SEQ ID NO: 3659 - protein, 112 aa, Artificial Sequence
  Description of Artificial Sequence: Synthetic polypeptide
  MOD_RES (1)..(1): Any amino acid
  MOD_RES (7)..(7): Any amino acid
  MOD_RES (46)..(46): Any amino acid
  MOD_RES (63)..(63): Any amino acid
  MOD_RES (75)..(76): Any amino acid
  MOD_RES (89)..(89): Any amino acid
  MOD_RES (107)..(107): Any amino acid
XVQLVEXGGGLVQPGGSLRLSCAASGFTFSRYSMSWVRQAPGKGLXLVAQINSVGNSTYYPDXVKGRFTISRDNXXNTLYLQMNSLRAXDTAVYYCASGDYWGQGTXVTVSS

SEQ ID NO: 3660 - protein, 112 aa, Artificial Sequence
  Description of Artificial Sequence: Synthetic polypeptide
EVQLVESGGGLVQPGGSLRLSCAASGFTFSSYGMSWVRQAPGKGLELVASINSNGGSTYYPDSVKGRFTISRDNAKNSLYLQMNSLRAEDTAVYYCASGDYWGQGTTVTVSS

SEQ ID NO: 3661 - protein, 112 aa, Artificial Sequence; identical to SEQ ID NO: 3660
  Description of Artificial Sequence: Synthetic polypeptide

SEQ ID NO: 3662 - protein, 118 aa, Artificial Sequence
  Description of Artificial Sequence: Synthetic polypeptide
QVQLVQSGAEVKKPGSSVKVSCKASGGTFSSYAISWVRQAPGQGLEWMGRIIPIFGIANYAQKFQGRVTITADKSTSTAYMELSSLRSEDTAVYYCARGTTASPLDYWGQGTLVTVSS

SEQ ID NO: 3663 - protein, 114 aa, Artificial Sequence
  Description of Artificial Sequence: Synthetic polypeptide
DIVMTQSPDSLAVSLGERATINCKSSQSVIHNSNVKNCLAWYQQKLGQPPNLLIYWASTRESGVPDRFSGSGSGTDFTLKISRVEAEDVGVYYCMQSIQLPRTFGQGTKVEIKR

SEQ ID NO: 3664 - protein, 123 aa, Artificial Sequence
  Description of Artificial Sequence: Synthetic polypeptide
EVQLVESGTEVKKPGESLKISCKGSEYRFSSYWIAWVRQMPGKGLDWMGLIYPGDSDTRYSPSFQGQVTISADKSISTAYLQWSSLKASDTAMYYCARHQLRGIAARSPFDIWGQGTMVTVSS

SEQ ID NO: 3665 - protein, 122 aa, Artificial Sequence
  Description of Artificial Sequence: Synthetic polypeptide
QVQLQQSGAEVKKPGASVKVSCKASGYTFSSYYMHWVRQAPGQGLEWMGIINPSGGSTSYAQKFQGRVTMTRDTSTSTVYMELSSLRSEDTAVYYCARPRYNWNDGDAFDIWGQGTMVTVSS

SEQ ID NO: 3666 - protein, 123 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGRSIAARPWYYFDYWGQGTLVTVSS

SEQ ID NO: 3667 - protein, 123 aa, Artificial Sequence
  Description of Artificial Sequence: Synthetic polypeptide
QVQLVQSGGGLVQPGRSLRLSCTASGFTFGDYAMSWVRQAPGKGLEWVGFIRSKAYGGTTEYAASVKGRFTISRDDSKSIAYLQMNSLKTEDTAMYYCTRVRSGSYYARPDYWGQGTLVTVSS

SEQ ID NO: 3668 - protein, 121 aa, Artificial Sequence
  Description of Artificial Sequence: Synthetic polypeptide
EVQLVESGGGVVQPGRSLRLSCAASGFTFSDYGMHWVRQAPGKGLEWVFLTSHDGSNTKYADSVKGRFTISRDNSKNTVYLQMNSLRADDTAVYYCANGFCGSNCYYFHHWGRGTTVTVSS

SEQ ID NO: 3669 - protein, 123 aa, Artificial Sequence
  Description of Artificial Sequence: Synthetic polypeptide
QVQLVQSGGGLVQPGGSQRLSCAASGFGFSNYAVSWVRQAPGTGLEWVAGVNGGGQNTFYADSVKGRFTISRDNSKKTVYLQMNSLRVEDTAIYYCAKDGRFRNRRPDGFDTWGQGTLVTVSS

SEQ ID NO: 3670 - protein, 123 aa, Artificial Sequence
  Description of Artificial Sequence: Synthetic polypeptide
QVQLVQSGGGVVQPGGSLRLSCAASGFTFSRYAMSWVRQAPGKGLEWVSAMSGSGDTTYYADSVKGRFTISRDNSKKTVYLQMNRLRVEDTAIYYCAKDGRFRNRRSDGFDTWGQGTLVTVSS

SEQ ID NO: 3671 - protein, 125 aa, Artificial Sequence
  Description of Artificial Sequence: Synthetic polypeptide
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARAKRFAAARRGLDAFDIWGQGTMVTVSS

SEQ ID NO: 3672 - protein, 117 aa, Artificial Sequence
  Description of Artificial Sequence: Synthetic polypeptide
QVTLKESGGDLVKPGGSLRLSCAASGFTFRKYYMAWIRQAPGKGPEWLSTISNSGDIIDYADSVRGRFSISRDNAQKSLYLQMTSLRPDDSAIYYCAREYFFSFDVWGRGTLVTVSS

SEQ ID NO: 3673 - protein, 123 aa, Artificial Sequence
  Description of Artificial Sequence: Synthetic polypeptide
EVQLLESGGGLVQPGGSLRLSCAASGFTFSFYGMVWVRQAPGKGLEWVSSISPSGGYTLYADSVKGRFTISRDNSKNTLYLQMNSLRAEDTAVYYCAKDGRRPHYGSGRWAYWGQGTLVTVSS

SEQ ID NO: 3674 - protein, 118 aa, Artificial Sequence
  Description of Artificial Sequence: Synthetic polypeptide
EVQLLESGGGLVQPGGSLRLSCAASGFTFSRYLMMWVRQAPGKGLEWVSVISPSGGRTWYADSVKGRFTISRDNSKNTLYLQMNSLRAEDTAVYYCVRSIAAAGTDYWGQGTLVTVSS

SEQ ID NO: 3675 - protein, 113 aa, Artificial Sequence
  Description of Artificial Sequence: Synthetic polypeptide
EVQLLESGGGLVQPGGSLRLSCAASGFTFSNYFMIWVRQAPGKGLEWVSWISPSGGTTQYADSVKGRFTISRDNSKNTLYLQMNSLRAEDTAVYYCAREAGYWGQGTLVTVSS

SEQ ID NO: 3676 - protein, 119 aa, Artificial Sequence
  Description of Artificial Sequence: Synthetic polypeptide
EVQLLESGGGLVQPGGSLRLSCAASGFTFSAYYMGWVRQAPGKGLEWVSVIRPSGGKTKYADSVKGRFTISRDNSKNTLYLQMNSLRAEDTAVYYCARGPHGQGGVDSWGQGTLVTVSS

SEQ ID NO: 3677 - protein, 126 aa, Artificial Sequence
  Description of Artificial Sequence: Synthetic polypeptide
EVQLLESGGGLVQPGGSLRLSCAASGFTFSEYFMTWVRQAPGKGLEWVSSIRPSGGKTRYADSVKGRFTISRDNSKNTLYLQMNSLRAEDTAVYYCARVSRYYNNGAYRLDAFDIWGPGTVVTVSS

SEQ ID NO: 3678 - protein, 118 aa, Artificial Sequence
  Description of Artificial Sequence: Synthetic polypeptide
EVQLLESGGGLVQPGGSLRLSCAASGFTFSAYRMAWVRQAPGKGLEWVSYISSSGGVTSYADSVKGRFTISRDNSKNTLYLQMKSLRAEDTAVYYCARGTHLPGVDYWGQGTLVTVSS

SEQ ID NO: 3679 - protein, 113 aa, Artificial Sequence
  Description of Artificial Sequence: Synthetic polypeptide
EVQLLESGGGLVQPGGSLRLSCAASGFTFSGYIMAWVRQAPGKGLEWVSGIGSSGGLTAYADSVKGRFTISRDNSKNTLYLQMNSLRAEDTAVYYCAREAGYWGQGTLVTVSS

SEQ ID NO: 3680 - protein, 129 aa, Artificial Sequence
  Description of Artificial Sequence: Synthetic polypeptide
EVQLLESGGGLVQPGGSLRLSCAASGFTFSSYPMVWVRQAPGKGLEWVSGIWSSGGLTYYADSVKGRFTISRDNSKNTLYLQMNSLRAEDTAVYYCAREGSAGVVKGPARYYYYYMDVWGKGTTVTVSS

SEQ ID NO: 3681 - protein, 126 aa, Artificial Sequence
  Description of Artificial Sequence: Synthetic polypeptide
EVQLLESGGGLVQPGGSLRLSCAASGFTFSKYQMTWVRQAPGKGLEWVSVISSSGGDTAYADSVKGRFTISRDNSKNTLYLQMNSLRAEDTAVYYCARDRGYCSGNTCYIDAFDIWGQGTMVTVSS

SEQ ID NO: 3682 - protein, 119 aa, Artificial Sequence
  Description of Artificial Sequence: Synthetic polypeptide
EVQLLESGGGLVQPGGSLRLSCAASGFTFSPYWMFWVRQAPGKGLEWVSGIVSSGGMTGYADSVKGRFTISRDNSKNTLYLQMNSLRAEDTAVYYCARVGMSTYAFDIWGQGTMVTVSS

SEQ ID NO: 3683 - protein, 118 aa, Artificial Sequence
  Description of Artificial Sequence: Synthetic polypeptide
EVQLLESGGGLVQLGGSLRLSCAASGFTFSHYGMSWVRQAPGKGLEWVSSIRSSGGRTWYADSVKGRFTISRDNSKNTLYLQMNSLRAEDTAVYYCAKGSLSSGWDYWGQGTLVTVSS

SEQ ID NO: 3684 - protein, 113 aa, Artificial Sequence
  Description of Artificial Sequence: Synthetic polypeptide
EVQLLESGGGLVQPGGSLRLSCAASGFTFSNYRMEWVRQAPGKGLEWVSSIWSSGGLTKEADSVKGRFTISRDNSKNTLYLQMNSLRAEDTAVYYCARGLYRWGQGTLVTVSS

SEQ ID NO: 3685 - protein, 118 aa, Artificial Sequence
  Description of Artificial Sequence: Synthetic polypeptide
EVQLLESGGGLVQPGGSLRLSCAASGFTFSWYLMHWVRQAPGKGLEWVSSIVPSGGTTVYADSVKGRFTISRDNSKNTLYLQMNSLRAEDTAVYYCARDLWFGEWDYWGQGTLVTVSS

SEQ ID NO: 3686 - protein, 122 aa, Artificial Sequence
  Description of Artificial Sequence: Synthetic polypeptide
EVQLLESGGGLVQPGGSLRLSCAASGFTFSWYSMVWVRQAPGKGLEWVSSIGPSGGMTRYADSVKGRFTISRDNSKNTLYLQMNSLRAEDTAVYYCARDQGITMVQGAMGYWGQGTLVTVSS

SEQ ID NO: 3687 - protein, 119 aa, Artificial Sequence
  Description of Artificial Sequence: Synthetic polypeptide
EVQLLESGGGLVQPGGSLRLSCAASGFTFSVYSMAWVRQAPGKGLEWVSGIWPSGGPTAYADSVKGRFTISRDNSKNTLYLQMNSLRAEDTAVYYCAREDFWSGLEDVWGKGTTVTVSS

SEQ ID NO: 3688 - protein, 115 aa, Artificial Sequence
  Description of Artificial Sequence: Synthetic polypeptide
EVQLLESGGGLVQPGGSLRLSCAASGFTFSMYMMDWVRQAPGKGLEWVSSIWPSGGQTWYADSVKGRFTISRDNSKNTLYLQMNSLRAEDTAVYYCARSVLLDYWGQGTLVTVSS

SEQ ID NO: 3689 - protein, 128 aa, Artificial Sequence
  Description of Artificial Sequence: Synthetic polypeptide
EVQLLESGGGLVQPGGSLRLSCAASGFTFSYYAMQWVRQAPGKGLEWVSSLYPSGGNTSYADSVKGRFTISRDNSKNTLYLQMNSLRAEDTAVYYCARGRGNYDFWSAGYYYYYMDVWGKGTTVTVSS

SEQ ID NO: 3690 - protein, 128 aa, Artificial Sequence; identical to SEQ ID NO: 3689
  Description of Artificial Sequence: Synthetic polypeptide

SEQ ID NO: 3691 - protein, 115 aa, Artificial Sequence
  Description of Artificial Sequence: Synthetic polypeptide
EVQLVQSGPELKKPGASVKISCKASGYTFTDYNMHWVKQAHGKGLEWIGYIYPHNGGTGYNQRFKSKATLTVDKSTSTAYMELRSLTSEDSAVYYCARPGTEAYWGQGTLVTVSS

SEQ ID NO: 3692 - protein, 115 aa, Artificial Sequence
  Description of Artificial Sequence: Synthetic polypeptide
EVQLVQSGAEVKKPGASVKISCKASGYTFTDYNMHWVKQAHGKGLEWIGYIYPHNGGTGYNQRFKSKATLTVDKSTSTAYMELSSLRSEDSAVYYCARPGTEAYWGQGTLVTVSS

SEQ ID NO: 3693 - protein, 115 aa, Artificial Sequence
  Description of Artificial Sequence: Synthetic polypeptide
EVQLVQSGAEVKKPGASVKISCKASGYTFTDYNMHWVKQAPGKGLEWIGYIYPHNGGTGYNQRFKSKATLTVDKSTSTAYMELSSLRSEDTAVYYCARPGTEAYWGQGTLVTVSS

SEQ ID NO: 3694 - protein, 115 aa, Artificial Sequence
  Description of Artificial Sequence: Synthetic polypeptide
EVQLVQSGAEVKKPGASVKISCKASGYTFTDYNMHWVRQAPGKGLEWIGYIYPHNGGTGYNQRFKSKATLTVDKSTSTAYMELSSLRSEDTAVYYCARPGTEAYWGQGTLVTVSS

SEQ ID NO: 3695 - protein, 115 aa, Artificial Sequence
  Description of Artificial Sequence: Synthetic polypeptide
EVQLVQSGAEVKKPGASVKVSCKASGYTFTDYNMHWVRQAPGKGLEWIGYIYPHNGGTGYNQRFKSKATITVDKSTSTAYMELSSLRSEDTAVYYCARPGTEAYWGQGTLVTVSS

SEQ ID NO: 3696 - protein, 131 aa, Artificial Sequence
  Description of Artificial Sequence: Synthetic polypeptide
MNFGLSLIFLVLVLKGVLCEVKLVESGGGLVQPGGSLKLSCAASGFTFSRYSMSWVRQTPEKRLELVAKISNSGDNTYYPDTLKGRFTISRDNAQNTLYLQMSSLKSEDTAMYYCASGDYWGQGTTLTVSS

SEQ ID NO: 3697 - protein, 131 aa, Artificial Sequence
  Description of Artificial Sequence: Synthetic polypeptide
MNFGLSLIFLVLVLKGVLCEVKLVESGGGLVQPGGSLKLSCAASGFTFSDYTMSWVRQTPEKRLELVAEISNTGGSTYYPDTVKGRFTISRDNAKNTLYLQMSSLKSEDTAMYYCASGDYWGQGTTLTVSS

SEQ ID NO: 3698 - protein, 131 aa, Artificial Sequence
  Description of Artificial Sequence: Synthetic polypeptide
MNFGLSLIFLVLVLKGVLCEVKLVESGGGLVQPGGSLKLSCAASGFTFSRYSMSWVRQTPEKRLELVAQINSVGNSTYYPDTVKGRFTISRDNAEYTLSLQMSGLRSDDTATYYCASGDYWGQGTTLTVSS

SEQ ID NO: 3699 - protein, 120 aa, Artificial Sequence
  Description of Artificial Sequence: Synthetic polypeptide
QVQLVESGGGVVQPGRSLRLSCAFSGFSLSTSGMSVGWIRQAPGKGLEWLAHIWWDDDKYYNPSLKSRLTISKDTSKNTVYLQMNSLRAEDTAVYYCARRTTTADYFAYWGQGTTVTVSS

SEQ ID NO: 3700 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWVAHIWWDDDKYYNPSLKSRFTISKDTSKNTLYLQMNSLRAEDTAVYYCARRTTTADYFAYWGQGTTVTVSS

SEQ ID NO: 3701 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWVAHIWWDDDKYYNPSLKSRFTISKDNSKNTLYLQMNSLRAEDTAVYYCARRTTTADYFAYWGQGTTVTVSS

SEQ ID NO: 3702 - protein, 120 aa, Artificial Sequence; identical to SEQ ID NO: 3420
  Description of Artificial Sequence: Synthetic polypeptide

SEQ ID NO: 3703 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWLAHIWWDDDKYYNPSLKSRLTISKDTSKNTVYLQMNSLRAEDTAVYYCARRTTTADYFAYWGQGTTVTVSS

SEQ ID NO: 3704 - protein, 120 aa, Artificial Sequence; identical to SEQ ID NO: 3402
  Description of Artificial Sequence: Synthetic polypeptide

SEQ ID NO: 3705 - protein, 120 aa, Artificial Sequence; identical to SEQ ID NO: 3403
  Description of Artificial Sequence: Synthetic polypeptide

SEQ ID NO: 3706 - protein, 120 aa, Artificial Sequence; identical to SEQ ID NO: 3404
  Description of Artificial Sequence: Synthetic polypeptide

SEQ ID NO: 3707 - protein, 120 aa, Artificial Sequence; identical to SEQ ID NO: 3405
  Description of Artificial Sequence: Synthetic polypeptide

SEQ ID NO: 3708 - protein, 120 aa, Artificial Sequence; identical to SEQ ID NO: 3406
  Description of Artificial Sequence: Synthetic polypeptide

SEQ ID NO: 3709 - protein, 121 aa, Artificial Sequence; identical to SEQ ID NO: 3407
  Description of Artificial Sequence: Synthetic polypeptide

SEQ ID NO: 3710 - protein, 121 aa, Artificial Sequence; identical to SEQ ID NO: 3408
  Description of Artificial Sequence: Synthetic polypeptide

SEQ ID NO: 3711 - protein, 120 aa, Artificial Sequence; identical to SEQ ID NO: 3409
  Description of Artificial Sequence: Synthetic polypeptide

SEQ ID NO: 3712 - protein, 120 aa, Artificial Sequence; identical to SEQ ID NO: 3410
  Description of Artificial Sequence: Synthetic polypeptide

SEQ ID NO: 3713 - protein, 120 aa, Artificial Sequence; identical to SEQ ID NO: 3411
  Description of Artificial Sequence: Synthetic polypeptide

SEQ ID NO: 3714 - protein, 120 aa, Artificial Sequence; identical to SEQ ID NO: 3412
  Description of Artificial Sequence: Synthetic polypeptide

SEQ ID NO: 3715 - protein, 120 aa, Artificial Sequence; identical to SEQ ID NO: 3413
  Description of Artificial Sequence: Synthetic polypeptide

SEQ ID NO: 3716 - protein, 120 aa, Artificial Sequence; identical to SEQ ID NO: 3414
  Description of Artificial Sequence: Synthetic polypeptide

SEQ ID NO: 3717 - protein, 120 aa, Artificial Sequence; identical to SEQ ID NO: 3415
  Description of Artificial Sequence: Synthetic polypeptide

SEQ ID NO: 3718 - protein, 120 aa, Artificial Sequence; identical to SEQ ID NO: 3416
  Description of Artificial Sequence: Synthetic polypeptide

SEQ ID NO: 3719 - protein, 120 aa, Artificial Sequence
  Description of Artificial Sequence: Synthetic polypeptide
QVQLVESGGGVVQPGRSLRLSCAFSGFTLSTSGMSVGWIRQAPGKGLEWLAHIWWDDDKYYNPSLKSRFTISKDNSKNTLYLQMNSLRAEDTAVYYCARRTTTADYFAYWGQGTTVTVSS

SEQ ID NO: 3720 - protein, 134 aa, Artificial Sequence
  Description of Artificial Sequence: Synthetic polypeptide
MKYLLPTAAAGLLLLAAQPAMADVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 3721 - protein, 120 aa, Artificial Sequence
  Description of Artificial Sequence: Synthetic polypeptide
MRLPAQLLGLLMLWVSGSSGDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTP

SEQ ID NO: 3722 - protein, 119 aa, Artificial Sequence [sequence omitted]

SEQ ID NO: 3723 - protein, 120 aa, Artificial Sequence; identical to SEQ ID NO: 3699
  Description of Artificial Sequence: Synthetic polypeptide

SEQ ID NO: 3724 - protein, 119 aa, Artificial Sequence
  Description of Artificial Sequence: Synthetic polypeptide
EVQLLESGGGLVQPGGSLRLSCAASGFTFSNYGMSWVRQAPGKGLEWVASIRSGGGRTYYSDNVKGRFTISRDNAKNSLYLQMNSLRAEDTALYYCVRYDHYSGSSDYWGQGTLVTVSS

SEQ ID NO: 3725 - protein, 120 aa, Artificial Sequence; identical to SEQ ID NO: 3701
  Description of Artificial Sequence: Synthetic polypeptide

SEQ ID NO: 3726 - protein, 112 aa, Artificial Sequence
  Description of Artificial Sequence: Synthetic polypeptide
EVQLVESGGGLVKPGGSLRLSCAASGYTFSRYSMSWVRQAPGKGLEWVGQINIRGCNTYYPDTVKGRFTISRDDSKNTLYLQMNSLKTEDTAVYYCTTGDFWGQGTLVTVSS

SEQ ID NO: 3727 - protein, 112 aa, Artificial Sequence
  Description of Artificial Sequence: Synthetic polypeptide
EVQLVESGGGLVKPGGSLRLSCAASGYTFSRYSMSWVRQAPGKGLEWVGQINIRGNNTYYPDTVKGRFTISRDDSKNTLYLQMNSLKTEDTAVYYCTTGDFWGQGTLVTVSS

SEQ ID NO: 3728 - protein, 120 aa, Artificial Sequence
  Description of Artificial Sequence: Synthetic polypeptide
EVQLVESGGGVVQPGGSLRLSCAASGFTFRNYDMHWVRQGIGKGLEWIGEINRSGATNYNPSLKSRFTISRENAKDSLYLQMNSLRVGDAAVYYCARGAGRWAPLGAFDIWGQGTLVIVS

SEQ ID NO: 3729 - protein, 120 aa, Artificial Sequence
  Description of Artificial Sequence: Synthetic polypeptide
EVQLVESGGGVVQPGGSLRLSCAASGFTFRGYWMSWVRQAPGKGLEWVASVKQDGSEKYYVDSVKGRFTISRDTSKNTLYLQMNSLRAEDTAVYYCARDGSSWYRDWFDPWGQGTLVTVS

SEQ ID NO: 3730 - protein, 120 aa, Artificial Sequence
  Description of Artificial Sequence: Synthetic polypeptide
EVQLVESGGGVVQPGGSLRLSCAASGFTFRSYWMSWVRQAPGKGLEWVASVKQFFSGPLATGSVKGRFTISRDNAKNTLYLQMNSLRAEDTAVYYCARDASSWYRDWFDPWGQGTLVTVS

SEQ ID NO: 3731 - protein, 120 aa, Artificial Sequence
  Description of Artificial Sequence: Synthetic polypeptide
EVQLVESGGGVVQPGGSLRLSCAASGFTFRGYWMSWVRQAPGKGLEWVASVKQDGSEKYYVDSVKGRPTISRDNAKNQFSLKLSSVTAADTAVYYCARDGSSWYRDWFDPWGQGTLVSVS

SEQ ID NO: 3732 - protein, 120 aa, Artificial Sequence
  Description of Artificial Sequence: Synthetic polypeptide
EVQLVESGGGVVQPGGSLRLSCAASGFTFRNYDMHWVRQGIGKGLEWVGRIGTAGRTNYNPSLKGRFTISRENAKDSLYLQMNSLRVGDAAVYYCARGAGRWAPLGAFDIWGQGTLVIVS

SEQ ID NO: 3733 - protein, 120 aa, Artificial Sequence
  Description of Artificial Sequence: Synthetic polypeptide
EVQLVESGGGVVQPGGSLRLSCAASGFTFRNYDMHWVRQGIGKGLVWVSRIGTAGDRYYAGSVKGRFTISRENAKDSLYLQMNSLRVGDAAVYYCARGAGRWAPLGAFDIWGQGTLVIVS

SEQ ID NO: 3734 - protein, 120 aa, Artificial Sequence
  Description of Artificial Sequence: Synthetic polypeptide
EVQLVESGGGVVQPGGSLRLSCAASGFTFSSYWMSWVRQAPGKGLEWVASVKQDGSEKYYVDSVKGRFTISRDNAKNTLYLQMNSLRAEDTAVYYCARDGSSWYRDWFDPWGQGTLVTVS

SEQ ID NO: 3735 - protein, 120 aa, Artificial Sequence
  Description of Artificial Sequence: Synthetic polypeptide
EVQLVESGGGVVQPGGSLRLSCAASGFTFRSYDMSWVRQAPGKGLEWVASVKQFFSGSAATGSVKGRFTISRDNAKNTLYLQMNSLRAEDTAVYYCARDGSSWYRDWFDPWGQGTLVTVS

SEQ ID NO: 3736 - protein, 120 aa, Artificial Sequence
  Description of Artificial Sequence: Synthetic polypeptide
EVQLVESGGGVVQPGGSLRLSCAASGFTFRSYDMSWVRQAPGKGLEWVASVKQDGSEKYYVDSVKGRPTISRDNAKNQLSLKLSSVTAADTAVYYCARDGSSWYRDWFDPWGQGTLVTVS

SEQ ID NO: 3737 - protein, 120 aa, Artificial Sequence
  Description of Artificial Sequence: Synthetic polypeptide
EVQLVESGGGVVQPGGSLRLSCAASGFTFRGYWMSWVRQAPGKGLEWVASVKQDGSEKYYVDSVKGRLTLSVDTSKNQFSLKLSSVTAADTAVYYCARDGSSWYRDWFDPWGQGTLVSVS

SEQ ID NO: 3738 - protein, 120 aa, Artificial Sequence
  Description of Artificial Sequence: Synthetic polypeptide
EVQLVESGGGVVQPGGSLRLSCAASGFTFRGYWMSWVRQAPGKGLEWVASVKQDGSEKYYVDSVKGRVTISVETSKNQFSLKLSSVTAADTAVYYCARDGSSWYRDWFDPWGQGTLVSVS

SEQ ID NO: 3739 - protein, 120 aa, Artificial Sequence
  Description of Artificial Sequence: Synthetic polypeptide
EVQLVESGGGVVQPGGSLRLSCAASGFTFRSYWMHWVRQAPGKGLEWVASVKQDGSEKYYVDSVKGRVTISLDTSKNQFSLKLSSVTAADTAVYYCARDGSSWYRDWFDPWGQGTLVSVS

SEQ ID NO: 3740 - protein, 120 aa, Artificial Sequence
  Description of Artificial Sequence: Synthetic polypeptide
EVQLVESGGGVVQPGGSLRLSCAASGITFRSYDMSWVRQAPGKGLEWVASVKQDGSEKYYVDSVKGRFTVSRDNAKNTLYLQMNSLRAEDTAVYYCARDAGRWADLAFDIWGQGTLVTVS

SEQ ID NO: 3741 - protein, 120 aa, Artificial Sequence
  Description of Artificial Sequence: Synthetic polypeptide
EVQLVESGGGVVQPGGSLRLSCAASGFTFRSYWMHWVRQAPGKGLEWVASVKQDGSEKYYVDSVKGRVTITADRAKNTLYLQMNSLRAEDTAVYYCARDGSSWYRDWFDPWGQGTLVTVS

SEQ ID NO: 3742 - protein, 120 aa, Artificial Sequence
  Description of Artificial Sequence: Synthetic polypeptide
EVQLVESGGGVVQPGGSLRLSCAASGFTFRNYWMSWVRQAPGKGLEWVASVKQFFSGPLATGSVKGRFTISRDTSKNTLYLQMNSLRAEDTAVYYCARDGSSWYRDWFDPWGQGTLVTVS

SEQ ID NO: 3743 - protein, 120 aa, Artificial Sequence
  Description of Artificial Sequence: Synthetic polypeptide
EVQLVESGGGVVQPGGSLRLSCAASGFTFRGYWMSWVRQAPGKGLEWVASVKQFFSGKYYAGSVKGRVTISVETSKNQFSLKLSSVTAADTAVYYCARDASSWYRDWFDPWGQGTLVSVS

SEQ ID NO: 3744 - protein, 125 aa, Artificial Sequence
  Description of Artificial Sequence: Synthetic polypeptide
QVELVESGGGLVQPGGSLRLSCAASGFTFSSYAMSWVRQAPGKGLEWVSAINASGTRTYYADSVKGRFTISRDNSKNTLYLQMSLRAEDTAVYYCARGKGNTHKPYGYVRYFDVWGQGTLVTVSS

SEQ ID NO: 3745 - protein, 135 aa, Artificial Sequence
  Description of Artificial Sequence: Synthetic polypeptide
LLLVAAPRWVLSQLQLQESGPGLVKPSETLSLTCTVSGGSISRGSHYWGWIRQPPGKGLEWIGSIYYSGNTYFNPSLKSRVTISVDTSKNQFSLKLSSVTAADTAVYYCARLGPDDYTLDGMDVWGQGTTVTVSS

SEQ ID NO: 3746 - protein, 118 aa, Artificial Sequence
  Description of Artificial Sequence: Synthetic polypeptide
MKHLWFFLLLVAAPRWVLSQVQLQESGPGLVKPSETLSLTCTVSGGSVSSGGYYWSWIRQPPGKGLEWIGYIYYSGSTNYNPSLKSRVTISVDTSKNQFSLKLSSVTAADTAVYYCAR

SEQ ID NO: 3747 - protein, 118 aa, Artificial Sequence
  Description of Artificial Sequence: Synthetic polypeptide
MKHLWFFLLLVAAPRWVLSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAR

SEQ ID NO: 3748 - protein, 142 aa, Artificial Sequence
  Description of Artificial Sequence: Synthetic polypeptide
MDRLTSSFLLLIVPAYVLSQVTLKESGPGILQPSQTLSLTCSFSGFSLSTNGMGVSWIRQPSGKGLEWLAHIYWDEDKRYNPSLKSRLTISKDTSNNQVFLKITNVDTADTATYYCARRRIIYDVEDYFDYWGQGTTLTVSS

SEQ ID NO: 3749 - protein, 142 aa, Artificial Sequence
  Description of Artificial Sequence: Synthetic polypeptide
MKHLWFFLLLVAAPRWVLSQVQLQESGPGLVKPSETLSLTCTFSGFSLSTNGMGVSWIRQPPGKGLEWLAHIYWDEDKRYNPSLKSRLTISKDTSKNQVSLKLSSVTAADTAVYYCARRRIIYDVEDYFDYWGQGTTVTVSS

SEQ ID NO: 3750 - protein, 122 aa, Artificial Sequence
  Description of Artificial Sequence: Synthetic polypeptide
QVQLVQSGPEVKKPGASVKVSCTASGYTFTEYTMHWVRQAPGQGLEWMGGVNPYNDNTSYIRKLQGRVTLTVDRSSSTAYMELTSLTSDDTAVYYCARYGGLRPYYFPMDFWGQGTLVTVSS

SEQ ID NO: 3751 - protein, 123 aa, Artificial Sequence
  Description of Artificial Sequence: Synthetic polypeptide
QVQLVQSGAEVKKPGASVKVSCTASGYSFTGYFLHWVRQAPGQGLEWMGRINPDSGDTYAQKFQDRVTLTRDTSIGTVYMELTSLTSDDTAVYYCARVPRGTYLDPWDYFDYWGQGTLVTVSS

SEQ ID NO: 3752 - protein, 122 aa, Artificial Sequence
  Description of Artificial Sequence: Synthetic polypeptide
QVQLQQSGPELVKPGASVKISCKTSGYTFTEYTMHWVKQSHGKSLEWIGGVNPYNDNTSYIRKLQGKVTLTVDRSSSTAYMELRSLTSEDSAVYFCARYGGLRPYYFPMDFWGQGTSVTVSS

SEQ ID NO: 3753 - protein, 124 aa, Artificial Sequence
  Description of Artificial Sequence: Synthetic polypeptide
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAAHVLRFLEWLPDAFDIWGQGTLVTVSS

SEQ ID NO: 3754 - protein, 108 aa, Artificial Sequence
  Description of Artificial Sequence: Synthetic polypeptide
EIVLTQSPSSLSASLGDRVTITCRASQSISSYLNWYQQKPGKAPKLLIYAASSSQSGVPSRFRGSESGTDFTLTISNLQPEDFATYYCQQSYRTPFTFGPGTKVEIKR

SEQ ID NO: 3755 - protein, 123 aa, Artificial Sequence
  Description of Artificial Sequence: Synthetic polypeptide
VQLVQSGAEVKKPGASVKVSCTASGYSFTGYFLHWVRQAPGQGLEWMGRINPDSGDTIYAQKFQDRVTLTRDTSIGTVYMELTSLTSDDTAVYYCARVPRGTYLDPWDYFDYWGQGTLVTVSS

SEQ ID NO: 3756 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDAGIAVAGTGFDYWGQGTLVTVSS

SEQ ID NO: 3757 - protein, 119 aa, Artificial Sequence
  Description of Artificial Sequence: Synthetic polypeptide
EVQLVESGGGLVQPGGSLRLSCAGSGFTFSNYGMSWVRQAPGKGLEWVASIRSGGGRTYYSDNVKGRFTISRENAKNSLYLQMNSLRAEDTAVYYCVRYDHYSGSSDYWGQGTLVTVSS

SEQ ID NO: 3758 - protein, 219 aa, Artificial Sequence; identical to SEQ ID NO: 3419
  Description of Artificial Sequence: Synthetic polypeptide

SEQ ID NO: 3759 - protein, 449 aa, Artificial Sequence
  Description of Artificial Sequence: Synthetic polypeptide
EVQLVESGGGLVQPGGSLRLSCAGSGFTFSNYGMSWVRQAPGKGLEWVASIRSGGGRTYYSDNVKGRFTISRENAKNSLYLQMNSLRAEDTAVYYCVRYDHYSGSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3760 - protein, 117 aa, Artificial Sequence
  Description of Artificial Sequence: Synthetic polypeptide
QVQLQQSDAELVKPGASVKISCKVSGYTFTDHTIHWMKQRPEQGLEWIGYIYPRDGSTKYNEKFKGKATLTADKSSSTAYMQLNSLTSEDSAVYFCARDYGYAFDYWGQGTTLTVSS

SEQ ID NO: 3761 - protein, 117 aa, Artificial Sequence; identical to SEQ ID NO: 3760
  Description of Artificial Sequence: Synthetic polypeptide

SEQ ID NO: 3762 - protein, 112 aa, Artificial Sequence
  Description of Artificial Sequence: Synthetic polypeptide
EVQLVESGGGLVQPGGSLKLSCTASGFTFSSYGMSWVRQTPDKRLELVASIKNNGGSTYYPDSLKGRFTISRDNAKNTLYLQMSSLKSEDTAMYYCASGDYWGQGTTLTVSS

SEQ ID NO: 3763 - protein, 112 aa, Artificial Sequence
  Description of Artificial Sequence: Synthetic polypeptide
EVQLVESGGGLVQPGGSLKLSCAASGFTFSSYGMSWVRQTPDKRLELVASINSNGGSTYYPDSVKGRFTISRDNAKNTLYLQMSSLKSEDTAMYYCASGDYWGQGSTLTVSS

SEQ ID NO: 3764 - protein, 98 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 3765 - protein, 138 aa, Artificial Sequence
  Description of Artificial Sequence: Synthetic polypeptide
MNFGLSLIFLVLVLKGVQCEVQLLESGGGLVQPGGSLRLSCAASGFTFSNYGMSWVRQAPGKGLEWVASIRSGGGRTYYSDNVKGRFTISRDNSKNTLYLQMNSLRAEDTAVYYCVRYDHYSGSSDYWGQGTLVTVSS

SEQ ID NO: 3766 - protein, 142 aa, Artificial Sequence
  Description of Artificial Sequence: Synthetic polypeptide
MDRLTSSFLLLIVPAYVLSQATLKESGPGILQSSQTLSLTCSFSGFSLSTSGMGVSWIRQPSGKGLEWLAHIYWDDDKRYNPSLKSRLTISKDTSRKQVFLKITSVDPADTATYYCVRRPITPVLVDAMDYWGQGTSVTVSS

SEQ ID NO: 3767 - protein, 138 aa, Artificial Sequence
  Description of Artificial Sequence: Synthetic polypeptide
MNFGLSLIFLVLVLKGVQCEVKLVESGGGLVKPGASLKLSCAASGFTFSNYGMSWVRQNSDKRLEWVASIRSGGGRTYYSDNVKGRFTISRENAKNTLYLQMSSLKSEDTALYYCVRYDHYSGSSDYWGQGTTVTVSS

SEQ ID NO: 3768 - protein, 138 aa, Artificial Sequence
  Description of Artificial Sequence: Synthetic polypeptide
MNFGLSLIFLVLVLKGVQCEVQLLESGGGLVQPGGSLRLSCAASGFTFSNYGMSWVRQAPGKGLEWVASIRSGGGRTYYSDNVKGRFTISRDNAKNSLYLQMNSLRAEDTALYYCVRYDHYSGSSDYWGQGTLVTVSS

SEQ ID NO: 3769 - protein, 121 aa, Artificial Sequence
  Description of Artificial Sequence: Synthetic polypeptide
EVQLLESGGGLVQPGGSLRLSCAASGFTFSSYAVSWVRQAPGKGLEWVSAISGSGGSTYYADSVKGRFTISRDNAKNSLYLQMNSLRAEDTALYYCAKDNYDFWSGTFDYWGQGTLVTVSS

SEQ ID NO: 3770 - protein, 112 aa, Artificial Sequence [sequence omitted]

SEQ ID NO: 3771 - protein, 98 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAR

SEQ ID NO: 3772 - protein, 115 aa, Artificial Sequence
  Description of Artificial Sequence: Synthetic polypeptide
EVQLVESGGGLVQPGGSLRLSCAASGFTFSDNGMAWVRQAPGKGLEWVSFISNLAYSIDYADTVTGRFTISRDNAKNSLYLQMNSLRAEDTAVYYCVSGTWFAYWGQGTLVTVSS

SEQ ID NO: 3773 - protein, 115 aa, Artificial Sequence
  Description of Artificial Sequence: Synthetic polypeptide
EVQLVESGGGLVQPGGSLRLSCAVSGFTFSDNGMAWVRQAPGKGLEWVSFISNLAYSIDYADTVTGRFTISRDNAKNSLYLQMNSLRAEDTAVYYCVSGTWFAYWGQGTLVTVSS

SEQ ID NO: 3774 - protein, 115 aa, Artificial Sequence
  Description of Artificial Sequence: Synthetic polypeptide
EVQLVESGGGLVQPGGSLRLSCAASGFTFSDNGMAWVRQAPGKGLEWISFISNLAYSIDYADTVTGRFTISRDNAKNSLYLQMNSLRAEDTAVYYCVSGTWFAYWGQGTLVTVSS

SEQ ID NO: 3775 - protein, 127 aa, Artificial Sequence
  Description of Artificial Sequence: Synthetic polypeptide
EVQLVESGPGLVKPAETLSLTCTVSGGSIRSGSICWYWIRQPPGKGLEWIGYFCYSGATFYTPSLRGRLTISVDASKNQLSLSLSSVTAADTAVYYCARRAGENSGGIEPYYGMDVWGQGTTVTVSS

SEQ ID NO: 3776 - protein, 121 aa, Artificial Sequence
  Description of Artificial Sequence: Synthetic polypeptide
QVQLQESGPGLVKPSETLSLTCTVSGGSISRRSYYWGWIRQSPGKGLEWSGSIHYSGSTYYNPSLKSRVTISVDTSKNQFSLKLSSVTAADTAVYYCARSRWGSSWVFDYWGQGTLVTVSS

SEQ ID NO: 3777 - protein, 124 aa, Artificial Sequence
  Description of Artificial Sequence: Synthetic polypeptide
QVQLVESGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSS

SEQ ID NO: 3778 - protein, 124 aa, Artificial Sequence
  Description of Artificial Sequence: Synthetic polypeptide
EVQLVQSGGGVVQPGRSLRLSCAASGFAFSSYGIHWVRQAPGKGLEWVAVIWFDGTKKYYTDSVKGRFTISRDNSKNTLYLQMNTLRAEDTAVYYCARDRGIGARRGPYYMDVWGKGTTVTVSS

SEQ ID NO: 3779 - protein, 121 aa, Artificial Sequence; identical to SEQ ID NO: 3776
  Description of Artificial Sequence: Synthetic polypeptide

SEQ ID NO: 3780 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTISSLQPEDFATYYCQQSYSTRTFGQGTKVEIKR

SEQ ID NO: 3781 - protein, 124 aa, Artificial Sequence
  Description of Artificial Sequence: Synthetic polypeptide
EVQLVQSGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSS

SEQ ID NO: 3782 - protein, 123 aa, Artificial Sequence
  Description of Artificial Sequence: Synthetic polypeptide
QVTLKESGPVLVKPTETLTLTCTFSGFSLSTSGMGVSWIRQPPGKALEWLAHIYWDDDKRYNPSLKSRLTISKDTSKSQVVLTMTNMDPVDTATYYCVRRPITPVLVDAMDYWGQGTLVTVSS

SEQ ID NO: 3783 - protein, 453 aa, Artificial Sequence
  Description of Artificial Sequence: Synthetic polypeptide
QVTLKESGPVLVKPTETLTLTCTFSGFSLSTSGMGVSWIRQPPGKALEWLAHIYWDDDKRYNPSLKSRLTISKDTSKSQVVLTMTNMDPVDTATYYCVRRPITPVLVDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3784 - protein, 123 aa, Artificial Sequence
  Description of Artificial Sequence: Synthetic polypeptide
  MOD_RES (1)..(2): Any amino acid
  MOD_RES (64)..(64): Any amino acid
  MOD_RES (77)..(78): Any amino acid
  MOD_RES (83)..(84): Any amino acid
  MOD_RES (86)..(87): Any amino acid
  MOD_RES (118)..(118): Any amino acid
XXTLKESGPVLVKPTETLTLTCTFSGFSLSTSGMGVSWIRQPPGKALEWLAHIYWDDDKRYNPXLKSRLTISKDTSXXQVVLXXTXXDPVDTATYYCVRRPITPVLVDAMDYWGQGTXVTVSS

SEQ ID NO: 3785 - protein, 111 aa, Artificial Sequence
  Description of Artificial Sequence: Synthetic polypeptide
GGLVQPGGSLRLSCATSGFTFSDFFIEWVRQPPGKRLEWITASRNKNYDYKTEYSASVKGRFIVSRDTSQSILYLQMNALRAEDTAIYYCAIYRHYAMDYWGQGTSVTVSS

SEQ ID NO: 3786 - protein, 111 aa, Artificial Sequence
  Description of Artificial Sequence: Synthetic polypeptide
GGLVQPGGSLRLSCAISGFTFSDFYMEWVRQPPGKRLEWIAASRNKANDYTTEYSASVKGRFIVSRDTSQSILYLQMNALRAEDTAIYYCATYHDYAMDYWGQGTSVTVSS

SEQ ID NO: 3787 - protein, 111 aa, Artificial Sequence
  Description of Artificial Sequence: Synthetic polypeptide
GGLVQPGGSLRLSCATSGFTFSDFYMEWVRQPPGRRLEWIAASRDKAKDYTTEYSASVKGRFIVSRDTSQSIFYLQMNALRSEDTAIYYCATYFSYAMDYWGLGTSVTVSS

SEQ ID NO: 3788 - protein, 110 aa, Artificial Sequence
  Description of Artificial Sequence: Synthetic polypeptide
GGLVQPGGSLRLSCATAGFTFTDQYMSWVRQPPGKALEWLATIRNKAKGFTTEYSASVKGRFTISRDNSQSILYLQMSTLRAGDSATYYCAVYGNYAMDYWGQGTSVNVS

SEQ ID NO: 3789 - protein, 111 aa, Artificial Sequence
  Description of Artificial Sequence: Synthetic polypeptide
GGLVQPGGSLRLSCATSGFTFTDFYMEWVRQPPGKRLEWIAASRNKANGYTTEYSASVKGRFIVSRDTSQGILYLQMSALRAEDTAIYYCAIYRYYAMDYWGQGTSVTVSS

SEQ ID NO: 3790 - protein, 115 aa, Artificial Sequence
  Description of Artificial Sequence: Synthetic polypeptide
QLQQSGAELMKPGASVKISCKATGYTFSSYWIEWVKQRPGHGLEWIGEILPGRGSTHYNEKFKGKATFTADTSSNTAYMQLSSLTSEDSAVYYCARSPITTSDYWGQGTTLTVSS

SEQ ID NO: 3791 - protein, 96 aa, Artificial Sequence
  Description of Artificial Sequence: Synthetic polypeptide
AELKKPGASVKISCKATGYTFRSYWIEWVKQRPGHGLEWIGEILPGRGSTKYNEKFKGKATFTADTSSNTANMQLSSLTSEDSAVYYCARSPITTS

SEQ ID NO: 3792 - protein, 135 aa, Artificial Sequence
  Description of Artificial Sequence: Synthetic polypeptide
MEWSWVFLFLLSGTAGVLSEVQLQQSGPELVKPGSSVKISCKASRNTFTDYNLDWVKQSHGKTLEWIGNVYPNNGVTGYNQKFRGKATLTVDKSSSTAYMELHSLTSEDSAVYYCALYYYDVSYWGQGTLVTVSA

SEQ ID NO: 3793 - protein, 136 aa, Artificial Sequence
  Description of Artificial Sequence: Synthetic polypeptide
METGLRWLLLVAVLKGVQCQSVEESGGHLVTPGTPLTLTCTVSGIDLSTYAMGWVRQAPGKGLEWIGVITKSGNTYYASWAKGRFAISKTSTTVDLKITSPTTEDTATYFCGRYGIGVSYYDIWGPGTLVTVSSGQ

SEQ ID NO: 3794 - protein, 114 aa, Artificial Sequence
  Description of Artificial Sequence: Synthetic polypeptide
EVKLEESGGGLVQPGGSMKLSCTASGLTLSDAWMNWVRQSPEKGLEWVAEIRSKAYKHATYYAESVKGRFTISRDDSKSCIYLQMNTLRAEDTGIYYCTRHGSWGPGTLVTVSA

SEQ ID NO: 3795 - protein, 114 aa, Artificial Sequence
  Description of Artificial Sequence: Synthetic polypeptide
EVKLEESGGGLVQPGGSMKLSCTASGITLNDAWMTWVRQSPEKGLEWVGEIRNKANNHATNYAESVKGRFSISRDDSKGIVYLQMNSLRAEDTGNYYCTRHSYWGPGTLVTVSA

SEQ ID NO: 3796 - protein, 115 aa, Artificial Sequence
  Description of Artificial Sequence: Synthetic polypeptide
QIQLQQSGPELVKPGAAVKISCKASGYTFTDYYLNWVKQKPGQGLEWIGWIYPGSGNVKYNEKFKGKATLTADTSSNTAHMQLSSLTSEDTAVYFCTREGLIVYWGQGTLVTVSA

SEQ ID NO: 3797 - protein, 115 aa, Artificial Sequence
  Description of Artificial Sequence: Synthetic polypeptide
QIQLQQSGPDLVKPGASVKISCKASGYTFTDYYINWVKQKPGQGLEWIGWLNPGSGNTKYNEKFKGKATMTVDTTSSTVYMQLSSLTSEDSAVYFCTREGPIDYWGRGTSVTVSS

SEQ ID NO: 3798 - protein, 120 aa, Artificial Sequence
  Description of Artificial Sequence: Synthetic polypeptide
EVQLVQSGAEVKKPGESLKISCKAFGYSFTNFWIGWVRQVPGKGLEWVGIIYPGDSDTRYSPSFQGQVTISADKSIDTAYLQWGHLKASDSAMYFCARRGFWTGSQIEYWGQGTQVTVSS

SEQ ID NO: 3799 - protein, 115 aa, Artificial Sequence
  Description of Artificial Sequence: Synthetic polypeptide
QVQLVQSGAEVKKPGASVKVSCKASGYTFVNYIIHWVRQAPGQGLEWMGIINPNGGNTSYAEKFQARVTLTSDTSTSTVYMDLSSLTSEDTAVYYCAVLSPSNPWGQGTTVTVSS

SEQ ID NO: 3800 - protein, 126 aa, Artificial Sequence
  Description of Artificial Sequence: Synthetic polypeptide
QVQLVESGGGAVQPGGSLRLSCAASGFTFSDYAMHWVRQAPGKGLQWVAVISYEGTYKYYADSVKGRFTISRDNSKNTLNLQMSSLRVEDTAVYFCVKARAFASGQRSTSTVPDYWGQGTLVTVSS

SEQ ID NO: 3801 - protein, 121 aa, Artificial Sequence
  Description of Artificial Sequence: Synthetic polypeptide
EVQLVESGGGLVQPGGSLKLSCAASGFNFNISAIHWVRQASGKGLEWVGRIRSKSHNYATLYAASLKGRFTLSRDDSRNTAYLQMSSLQTEDMAVYYCTVLSANYDTFDYWGQGTLVTVSS

SEQ ID NO: 3802 - protein, 120 aa, Artificial Sequence
  Description of Artificial Sequence: Synthetic polypeptide
QVQLQQSGPELVKPGTSVKMPCKASGYIFTDYVISWVKQRTGQGLEWIGEIFPRSGSTYYNEKFKGKATLTADKSSNTAYMQLSSVTSEDSAVYFCARDYYGTSFAMDYWGQGTSVTVSS

SEQ ID NO: 3803 - protein, 120 aa, Artificial Sequence
  Description of Artificial Sequence: Synthetic polypeptide
QVQLVQSGAEVKKPGSSVKVSCKASGGTFSSYAISWVRQAPGQGLEWMGGIIPILGIANYAQKFQGRVTITADKSTSTAYMELSSLRSEDTAVYYCARENHCYYYGMDVWGQGTTVTVSS

SEQ ID NO: 3804 - protein, 120 aa, Artificial Sequence
  Description of Artificial Sequence: Synthetic polypeptide
QVQLVQSGPEVKKPGSSVKVPCKASGYIFTDYVISWVRQATGQGLEWMGEIFPRSGSTNYAQKFQGRVTITADKSTSTAYMELSSLRSEDTAVYYCARDYYGTSFAMDYWGQGTTVTVSS

SEQ ID NO: 3805 - protein, 120 aa, Artificial Sequence
  Description of Artificial Sequence: Synthetic polypeptide
QVQLQQSGAELARPGASVKLSCKASGYTFTSYGISWVKQRTGQGLEWIGEIYPRSGNTYYNEKFKGKATLTADKSSSTAYMELRSLTSEDSAVYFCARDYYGTYYAMDYWGQGTSVTVSS

SEQ ID NO: 3806 - protein, 120 aa, Artificial Sequence
  Description of Artificial Sequence: Synthetic polypeptide
QVQLVQSGPEVVKPGSSVKMPCKASGYIFSDYAISWVRQRTGQGLEWMGEIFPRSGSTNYAQKFQGRVTITADKSTSTAYMELSSLRSEDTAVYYCARDYYGTSYGMDVWGQGTTVTVSS

SEQ ID NO: 3807 - protein, 120 aa, Artificial Sequence
  Description of Artificial Sequence: Synthetic polypeptide
QVQLVQSGPEVVKPGSSVKMPCKASGYIFSDYAISWVRQRTGQGLEWMGEIFPRSGSTYYNQKFQGRVTITADKSTNTAYMQLSSLTSEDTAVYYCARDYYGTSYGMDVWGQGTTVTVSS

SEQ ID NO: 3808 - protein, 114 aa, Artificial Sequence
  Description of Artificial Sequence: Synthetic polypeptide
EVQLVESGGGLVQPGGSLRLSCAASGFTFPNYVMTWVRQAPGKGLEWVSGISGSGGSTDYADSVKGRFTISRDNSKNTLYLQMNSLRVEDTALYYCAKGSGGIWGQGTMVTVSS

SEQ ID NO: 3809 - protein, 120 aa, Artificial Sequence
  Description of Artificial Sequence: Synthetic polypeptide
EVQLVQSGAEVKKPGESLKISCKAFGYSFTNFWIGWVRQVPGKGLEWVGIIYPGDSDTRYSPSFQGQVTISADKSIDTAYLQWGHLKASDSAMYFCARRGFWTGSQIEYWGQGTLVTVSS

SEQ ID NO: 3810 - protein, 125 aa, Artificial Sequence
  Description of Artificial Sequence: Synthetic polypeptide
EVQLVESGGGVVQPGRSLRVSCAASGFTFSSYDMHWVRQAPGKGLEWVAVIWFDGSNEFYADSVKGRFTISRDNSKNTLFLQMNSLRAEDTAVYYCARDLGASVTTSNAENFHHWGQGTLVTVSS

SEQ ID NO: 3811 - protein, 125 aa, Artificial Sequence
  Description of Artificial Sequence: Synthetic polypeptide
QVQLVESGGGVVQPGRSLRVSCAASGFTFSSYDMHWVRQAPGKGLEWVAVIWFDGSNEFYADSVKGRFTISRDNSKNTLFLQMNSLRAEDTAVYYCARDLGASVTTSNAENFHHWGQGTLVTVSS

SEQ ID NO: 3812 - protein, 121 aa, Artificial Sequence
  Description of Artificial Sequence: Synthetic polypeptide
EVQLVESGGDLVQPGGSLRLSCAASGFDFSGYSMAWVRQAPGKGLEWVSYISGTYVSGGTGTMYYLDSVKGRFFISRDDATSSLYLQMDSLRDEDTAVYYCARVYDYGEDWGQGTLVTVSS

SEQ ID NO: 3813 - protein, 124 aa, Artificial Sequence
  Description of Artificial Sequence: Synthetic polypeptide
EVQLVESGGGLVQPGGSLRLSCAGTRFTFSTYAMGWVRQAPGRGLEWVSAIGGSGDSTSYADSVKGRFTISRDNSKNTLYLQMNSLRAEDTAVYYCAKGVYDYLWGSYRLFDYWGQGTLVTVSS

SEQ ID NO: 3814 - protein, 114 aa, Artificial Sequence
  Description of Artificial Sequence: Synthetic polypeptide
EVQLVESGGGLVQPGGSLRLSCAASGFTFPNYVMTWVRQAPGKGLEWVSGISGSGGSTDYADSVKGRFTISRDNSKNTLYLQMNSLRVEDTALYYCAKGSGGIRGQGTMVTVSS

SEQ ID NO: 3815 - protein, 118 aa, Artificial Sequence
  Description of Artificial Sequence: Synthetic polypeptide
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTSPTVTTEVWGQGTLVTVSS

SEQ ID NO: 3816 - protein, 122 aa, Artificial Sequence
  Description of Artificial Sequence: Synthetic polypeptide
EVQLVESGGGLVQPGGSLRLSCIGSSGMTFSSYAFNWVRQTPGKGLEWVSSISRFGSTVDYTDSVRGRFTISRDDGQRSLYLQMNSLRVEDTAVYYCVRSTASGSRSPGIIWGQGTTVTVSS

SEQ ID NO: 3817 - protein, 126 aa, Artificial Sequence
  Description of Artificial Sequence: Synthetic polypeptide
EVQLVQSGAEVKKPGESLKISCKGSGYRFTTYWIGWVRQMPGKGLEWMGIIYPGDSDTRYSPSYQGQVTISADKSISTAYLQWSSLKASDTGMYYCARVAGDIGYENYYYYGMDVWGQGTTVTVSS

SEQ ID NO: 3818 - protein, 118 aa, Artificial Sequence
  Description of Artificial Sequence: Synthetic polypeptide
QVQLVESGGGVVQPGRSLRLSCAASGFTFTRYGMHWVRQAPGKGLEWVAVIWYDGTNKYYADSLQGRFTISRDTSTNTLYLQMNGLRVEDRAVYYCAREGFQGAIDYWGQGTLVTVSS

SEQ ID NO: 3819 - protein, 120 aa, Artificial Sequence
  Description of Artificial Sequence: Synthetic polypeptide
EVQLVESGGGLVQPGGSLKLSCAASGFSFSDSAFHWARQASGKGLEWVGRIRSKGNNYATAYAASVKGRFTVSRDDSKNTTYLQMNSLKTDDTAIYYCTRQGPSYGGINWGLGTLVTVSS

SEQ ID NO: 3820 - protein, 115 aa, Artificial Sequence
  Description of Artificial Sequence: Synthetic polypeptide
EVQLVESGGGFVRPGGSITLSCATSGFTFTKAWMTWVRQAPVKGLEWIGHIKTRIEGATTDYAAPVEGRFTISRDDSKNMVYLQMNSLKTEDSGIYYCSTDFDYWGQGTLVTVSS

SEQ ID NO: 3821 - protein, 121 aa, Artificial Sequence
  Description of Artificial Sequence: Synthetic polypeptide
EVQLVQSGAEVKKPGDSLRISCKASGYNFPNYWIGWVRQMPGKGLEWMGIIYPGDSDIRYSPSFQGHVTISSDKSITTAYLQWTSLKVADSAMYYCARVERPDKGGWFGPWGQGTLVTVSS

SEQ ID NO: 3822 - protein, 114 aa, Artificial Sequence
  Description of Artificial Sequence: Synthetic polypeptide
EVQLVESGGGLVQPGGSLRLSCAASGFTFSAYGMNWVRQAPGKGLEWVAHITGSGTPIFYADSVKGRFTISRDNAKSSLYLQMNSLRNDDTALYFCVRGTVDYWGQGTLVTVSS

SEQ ID NO: 3823 - protein, 124 aa, Artificial Sequence
  Description of Artificial Sequence: Synthetic polypeptide
EVQLVQSGAEVKKPGESLKISCKASGYSFISYWVGWVRQMPGKGLEWMGIIYPGDSDTRYSPSFEGQVSISADKSISTAYLQWTSLKASDTAMYYCARHWGPAAVTDSPWFGPWGQGTLVTVSS

SEQ ID NO: 3824 - protein, 117 aa, Artificial Sequence
  Description of Artificial Sequence: Synthetic polypeptide
EVQLVESGAEVKKPGASVKVSCKASGYIFTAFFMHWVRQAPGQGLEWMGWINPDSGATKYAHNFQGRVTMTRDTSISTAFMELSGLKSDDTGVYYCATGMAVTGNFWGQGTLVTVSS

SEQ ID NO: 3825 - protein, 117 aa, Artificial Sequence
  Description of Artificial Sequence: Synthetic polypeptide
QVQLVQSGAEVKKPGASVKVSCKASGYIFTAFFMHWVRQAPGQGLEWMGWINPDSGATKYAHNFQGRVTMTRDTSISTAFMELSGLKSDDTGVYYCATGMAVTGNFWGQGTLVTVSS

SEQ ID NO: 3826 - protein, 117 aa, Artificial Sequence
  Description of Artificial Sequence: Synthetic polypeptide
EVHLVESGGALVKPGGSLRLSCAASGFSFSKYGMSWVRQAPGKGLEWVATISSSGSRTYYPDSVKGRFTISRDNAKNTLYLQMSSLKSEDTAMYYCSISWDGAMDYWGQGTSVTVSS

SEQ ID NO: 3827 - protein, 117 aa, Artificial Sequence
  Description of Artificial Sequence: Synthetic polypeptide
EVHLVESGGALVKPGGSLRLSCAASGFSFSKYGMSWVRQAPGKGLEWVATISSSGSRTYYPDSVKGRFTISRDNAKNTLYLQMNSLRAEDTAMYYCSISWDGAMDYWGQGTTVTVSS

SEQ ID NO: 3828 - protein, 117 aa, Artificial Sequence
  Description of Artificial Sequence: Synthetic polypeptide
EVQLVESGGALVKPGGSLRLSCAASGFSFSKYGMSWVRQAPGKGLEWVATISSSGSRTYYPDSVKGRFTISRDNAKNTLYLQMNSLRAEDTAMYYCSISWDGAMDYWGQGTTVTVSS

SEQ ID NO: 3829 - protein, 117 aa, Artificial Sequence
  Description of Artificial Sequence: Synthetic polypeptide
EVQLVESGGALVKPGGSLRLSCAASGFSFSKYGMSWVRQAPGKGLEWVATISSSGSRTYYPDSVKGRFTISRDNAKNTLYLQMNSLRAEDTAMYYCAISWDGAMDYWGQGTTVTVSS

SEQ ID NO: 3830 - protein, 119 aa, Artificial Sequence
  Description of Artificial Sequence: Synthetic polypeptide
QVQLQQSGTELMKPGASVKISCKATGYTFSSSWMGWVKQRPGHGLEWIGDILPGSGGTNYNERFKGKASFTAETSSNTAYMQLSSLTSEDSAVYYCVRSYYDYDRFANWGQGTLVTVSA

SEQ ID NO: 3831 - protein, 118 aa, Artificial Sequence
  Description of Artificial Sequence: Synthetic polypeptide
EVKLVESGGDLVKPGGSLKLSCAASGFTFSSYAMSWVRQNPEKRLEWVASISKGGNTYYPNSVKGRFTISRDNARNILYLQMSSLRSEDTALYYCARGWGDYGWFAYWGQVTLVTVSA

SEQ ID NO: 3832 - protein, 115 aa, Artificial Sequence
  Description of Artificial Sequence: Synthetic polypeptide
EVQLQQSGPELVKPGASVKISCKASGYTFTDYYMNWVKQSHGKSLEWIGDINPNRGGTTYNQKFKGKATLTVDKSSSTAYMELRSLTSEDSAVYYCASYYAVGYWGQGTTLTVSS

SEQ ID NO: 3833 - protein, 115 aa, Artificial Sequence
  Description of Artificial Sequence: Synthetic polypeptide
EVQLQQSGPELVKPGTSVKISCKASGYTFTDYYMNWVKQSHGKSLEWIGDINPNRGGTTYNQKFKGKATLTVDKSSSTAYMELRSLTSEDSAVYYCASYYAVGYWGQGTTLTVSS

SEQ ID NO: 3834 - protein, 115 aa, Artificial Sequence
  Description of Artificial Sequence: Synthetic polypeptide
EVQLQQSGPELVKPGASVKISCKASGYTFTDYYMNWVKQSHGKSLEWIGDINPNRGGTTYNQKFKGKATLTVDTSSSTAYMELRSLTSEDSAVYYCASYYAVGYWGQGTTLTVSS

SEQ ID NO: 3835 - protein, 120 aa, Artificial Sequence
  Description of Artificial Sequence: Synthetic polypeptide
EVQLVESGGGLVKPGGSLKLSCAPSGFTFSDYGMHWVRQAPEKGLEWVAYISSGSSTIYYGDTVKGRFTISRDNAKNTLFLQMTSLRSEDTAMYYCARRGQLRLRLFAYWGQGTLVTVSA

SEQ ID NO: 3836 - protein, 119 aa, Artificial Sequence
  Description of Artificial Sequence: Synthetic polypeptide
EVKLMESGGGLVHPGASLRLYCAASGFTFTDYYMSWVRQPPGKAPEWLALIRNKANGYTTEYTASVKGRFTISRDNSQNILYLQMNTLRAEDSATYYCVKALGRYFDVWGTGTTVTVSS

SEQ ID NO: 3837 - protein, 117 aa, Artificial Sequence
  Description of Artificial Sequence: Synthetic polypeptide
QVQLQQPGAELLKPGASVKLSCKASGYTFTSYWMHWVKQRPGRGLEWIGRIDPNSDRTKYNEKFKRKATLTVDKSSSTAYMQLSSLTSEDSAVYYCARDDYAWFAYWGQGTLVTVSA

SEQ ID NO: 3838 - protein, 119 aa, Artificial Sequence
  Description of Artificial Sequence: Synthetic polypeptide
QVTLKESGPGILQSSQTLSLTCSFSGFSLSTSGMGVSWIRQPSGKGLEWLAHIYWDDDKRYNASLKSRLTISKDTSRNQVFLKITCVDTADTATYYCARLLRPYALDYWGQGTSVTVSS

SEQ ID NO: 3839 - protein, 115 aa, Artificial Sequence
  Description of Artificial Sequence: Synthetic polypeptide
EVQLQQSGPELVKPGASVKISCKASGYTFTDYYMNWVKQSHGKSLEWIGDINPNNGGTSYNQKFKGKATLTVDKSSSTAYMELRSLTSEDSAVYYCVREGRFAYWGHGTLVTVSA

SEQ ID NO: 3840 - protein, 115 aa, Artificial Sequence
  Description of Artificial Sequence: Synthetic polypeptide
QVQLKQSGAELVRPGASVKLSCKASGYTFTDYYINWVKQRPGQGLEWIARIYPGRGNIYYNEKFKGKATLTAEKSSSTAYMQLSSLTSEDSAVYFCARFWDVTYWGQGTLVTVSA

SEQ ID NO: 3841 - protein, 115 aa, Artificial Sequence
  Description of Artificial Sequence: Synthetic polypeptide
EVQLQQSGPELVKPGASVKISCKASGFTFTDYYMNWVKQSHGKSLEWIGDINPNNGGTSYHQKFKGKATLTVDKSSSTAYMELRSLTSEDSAVYYCVREGRFAYWGQGTLVTVSA

SEQ ID NO: 3842 - protein, 115 aa, Artificial Sequence
  Description of Artificial Sequence: Synthetic polypeptide
QVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSS

SEQ ID NO: 3843 - protein, 115 aa, Artificial Sequence
  Description of Artificial Sequence: Synthetic polypeptide
EVQLVQSGAEVKKPGSSVKVSCKASGYTFTDYYMNWVRQAPGQGLEWIGDINPNRGGTTYNQKFKGRVTITVDKSTSTAYMELSSLRSEDTAVYYCASYYAVGYWGQGTTVTVSS

SEQ ID NO: 3844 - protein, 115 aa, Artificial Sequence; identical to SEQ ID NO: 3843
  Description of Artificial Sequence: Synthetic polypeptide

SEQ ID NO: 3845 - protein, 138 aa, Artificial Sequence
  Description of Artificial Sequence: Synthetic polypeptide
VQLQESGGGLVQPGGSRKLSCAASGFTFSNFGMHWVRQAPDKGLEWVAYITSGSSSIYYADTVKGRFTISRDNPKNTLFLQMTSLRSEDTAMYYCARSVPYGYGLFDYWGRGTTLTVSSAKTTPPSVYPLAPGSAAQT

SEQ ID NO: 3846 - protein, 132 aa, Artificial Sequence
  Description of Artificial Sequence: Synthetic polypeptide
VQLQESGGGLVQPGGSRKLSCAASGFTFSNFGMHWVRQAPDKGLEWVAYITSGSSSIYYADTVKGRFTISRDNPKNTLFLQMTSLRSEDTAMYYCARSVPYGYGLFDYWGRGTTLTVSSAKTTPPSVYPLAP

SEQ ID NO: 3847 - protein, 182 aa, Artificial Sequence
  Description of Artificial Sequence: Synthetic polypeptide
DFGLSWVFLALILKGIQCEVQLVESGGDLVKPGGSLKLSCAASGFNFRSYGMSWVRQTPDKRLEWVATISSGGNYTYYPDSVKGRFTISRDNAKNILYLQMSSLNSEDTALYYCTYSFYGAFDYWGQGTTLTVSSAKTTPPSVYPLAPGSAAQTNSMVTLGCLVKGYFPEPVTVTWNSGSLS

SEQ ID NO: 3848 - protein, 119 aa, Artificial Sequence
  Description of Artificial Sequence: Synthetic polypeptide
QIQLVQSGPELKKPGETVKISCKASGYTFTDYSMNWVKQAPGQGLKWVGWINTETGEPAYADDFKGRFAFSLETSASTAYLQINNLKNEDTATYFCATDFFDFWGQGTSLTVSSAKTTP

SEQ ID NO: 3849 - protein, 121 aa, Artificial Sequence
  Description of Artificial Sequence: Synthetic polypeptide
EVQLVESGGDLVRPGGSLKLSCAASGFTFRTYGMSWVRQTADKRLEWVATISSGGTYTYYADNVRERFTISRDNARDTLYLQMSRLESDDTAMYYCTRRYGYDGGGSFDVWGAGTRVTVSS

SEQ ID NO: 3850 - protein, 108 aa, Artificial Sequence
  Description of Artificial Sequence: Synthetic polypeptide
QSVEESGGRLVTPGTPLTLTCTVSGLSLSSNAINWVRQAPGKGLEWIGYISTSGNTYYASWAKGRFTISKTSTTVDLKITSPTTEDTATYFCGRGDLWGPGTLVTVSS

SEQ ID NO: 3851 - protein, 114 aa, Artificial Sequence
  Description of Artificial Sequence: Synthetic polypeptide
QSVEESGGRLVTPGTPLTLTCTVSGIDLSSYTMNWVRQAPGKGLDWIGFINSGGYTSYASWTRGRFTISKTSTTVDLRITSPTTEDTATYFCARYGGGSGFDLWGPGTLVTVSS

SEQ ID NO: 3852 - protein, 109 aa, Artificial Sequence
  Description of Artificial Sequence: Synthetic polypeptide
QSVEESGGRLVTPGTPLTLTCKVSGFSLSSYDMNWVRQAPGKGLEWVGAISTGGNTYYASWAKGRFTISKTSTTVTLTITSPTTADTATYFCARGSSIWGPGTLVTVSL

SEQ ID NO: 3853 - protein, 108 aa, Artificial Sequence
  Description of Artificial Sequence: Synthetic polypeptide
QSVEESGGRLVTPGTPLTLTCTVSGLSLSSNAINWVRQAPGKGLEWIGYIAVSGNTYYASWAKGRFTISKASTTVDLKMTSPTAEDTGTYFCGKSNIWGPGTLVTVSL

SEQ ID NO: 3854 - protein, 108 aa, Artificial Sequence
  Description of Artificial Sequence: Synthetic polypeptide
QSVEESGGRLVTPGTPLTLTCTVSGFSLSSNAINWVRQAPGKGLEWIGYIAVSGNTYYASWAKGRFTISKASTTVDLKMTSPTAEDTGTYFCGKSNIWGPGTLVTVSL

SEQ ID NO: 3855 - protein, 109 aa, Artificial Sequence
  Description of Artificial Sequence: Synthetic polypeptide
QSVEESGGRLVTPGTPLTLTCTVSGIDLSSYSITWVRQAPGKGLEYIGFIGTGGSTYYASWAKGRFTISRTSTTVDLKITSPTTEDTATYFCARGGDLWGPGTLVTVSS

SEQ ID NO: 3856 - protein, 123 aa, Artificial Sequence; identical to SEQ ID NO: 3458
  Description of Artificial Sequence: Synthetic polypeptide

SEQ ID NO: 3857 - protein, 475 aa, Artificial Sequence
  Description of Artificial Sequence: Synthetic polypeptide
MKHLWFFLLLVAAPRWVLSQVELVESGGGLVQPGGSLRLSCAASGFTFSSYAMSWVRQAPGKGLEWVSAINASGTRTYYADSVKGRFTISRDNSKNTLYLQMNSLRAEDTAVYYCARGKGNTHKPYGYVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3858 - protein, 215 aa, Artificial Sequence
  Description of Artificial Sequence: Synthetic polypeptide
DIVLTQSPATLSLSPGERATLSCRASQSVSSSYLAWYQQKPGQAPRLLIYGASSRATGVPARFSGSGSGTDFTLTISSLEPEDFATYYCLQIYNMPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3859 - protein, 219 aa, Artificial Sequence
  Description of Artificial Sequence: Synthetic polypeptide
DVVMTQSPLSLPVTLGQPASISCRSSQSLIYSDGNAYLHWFLQKPGQSPRLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3860 - protein, 214 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQFPTYLPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3861 - protein, 219 aa, Artificial Sequence
  Description of Artificial Sequence: Synthetic polypeptide
DIVMTQSPLSLPVTPGEPASISCRSSQSLVYSNGDTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3862 - protein, 219 aa, Artificial Sequence; identical to SEQ ID NO: 3861
  Description of Artificial Sequence: Synthetic polypeptide

SEQ ID NO: 3863 - protein, 234 aa, Artificial Sequence
  Description of Artificial Sequence: Synthetic polypeptide
MESQTQVFVYMLLWLSGVDGDIVMTQSQKFMSTSVGDRVSVTCKASQNVGTNVAWYQQKPGQSPKPLIYSASYRYSGVPDRFTGSGSGTDFTLTISNVQSEDLAEYFCQQFNSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3864 - protein, 215 aa, Artificial Sequence
  Description of Artificial Sequence: Synthetic polypeptide
GDIVMTQSQKFMSTSVGDRVSVTCKASQNVGTNVAWYQQKPGQSPKPLIYSASYRYSGVPDRFTGSGSGTDFTLTISNVQSEDLAEYFCQQFNSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3865 - protein, 107 aa, Artificial Sequence
  Description of Artificial Sequence: Synthetic polypeptide
DIKMTQSPSSMYASLGERVTITCKASQDINSYLSWFQQKPGKSPKTLIYRANRLVDGVPSRFSGSGSGQDYSLTISSLEYEDMGIYYCLQYDEYPYTFGGGTKLEIK

SEQ ID NO: 3866 - protein, 236 aa, Artificial Sequence
  Description of Artificial Sequence: Synthetic polypeptide
MDMRTPAQFLGILLLWFPGIKCDIKMTQSPSSMYASLGERVTITCKASQDINSYLSWFQQKPGKSPKTLIYRANRLVDGVPSRFSGSGSGQDYSLTISSLEYEDMGIYYCLQYDEYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3867 - protein, 120 aa, Artificial Sequence; identical to SEQ ID NO: 3703
  Description of Artificial Sequence: Synthetic polypeptide

SEQ ID NO: 3868 - protein, 449 aa, Artificial Sequence
  Description of Artificial Sequence: Synthetic polypeptide
QVQLVQSGGGLVQPGGSLRLSCAGSGFTFSNYGMSWVRQAPGKGLEWVASIRSGGGRTYYSDNVKGRFTISRENAKNSLYLQMNSLRAEDTAVYYCVRYDHYSGSSDYWGQGTLVTVSSASTKGPSVFPLAPSSKSTSGGTAALGCLVKDYFPQPVTVSWNSGALTSGVHTFPAVLQSSGLYSLSSVVTVPSSSLGTQTYICNVNHKPSNTKVDKKVEPKSCDKTHTCPPCPAPQLLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3869 - protein, 214 aa, Artificial Sequence
  Description of Artificial Sequence: Synthetic polypeptide
DIVLTQSPATLSLSPGERATLSCRASQSVSSSYLAWYQQKPGQAPRLLIYGASSRATGVPARFSGSGSGTDFTLTISSLEPEDFATYYCLQIYNMPITFGQGTKVEIKRTVAAPSVFIFPPSDEQLKSGTASVVCLLNNFYPREAKVQWKVDNALQSGNSQESTEQDSKDSTYSLSSTLTLSKADYEKHKVYACEVTHQGLSSPVTKSFNRGEC

SEQ ID NO: 3870 - protein, 215 aa, Artificial Sequence; identical to SEQ ID NO: 3858
  Description of Artificial Sequence: Synthetic polypeptide

SEQ ID NO: 3871 - protein, 239 aa, Artificial Sequence
  Description of Artificial Sequence: Synthetic polypeptide
MMSPAQFLFLLVLWIRETNGDVVMTQSPLSLPVTLGQPASISCKSSQSLLDSDGKTYLNWLQQRPGQSPRRLIYLVSKLDSGVPDRFSGSGSGTDFTLKISRVEAEDVGVYYCWQGTHFPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3872 - protein, 219 aa, Artificial Sequence
  Description of Artificial Sequence: Synthetic polypeptide
EIVMTQTPLSLPVSLGDRASISCRSGQSLVHSNTNTYLHWYLQKPGQSPKLLIYTVSNRFSGVPDRFSGSGSGSDFTLTISRVEAEDLGVYFCSQNTFVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3873 - protein, 219 aa, Artificial Sequence; identical to SEQ ID NO: 3872
  Description of Artificial Sequence: Synthetic polypeptide

SEQ ID NO: 3874 - protein, 219 aa, Artificial Sequence
  Description of Artificial Sequence: Synthetic polypeptide
EIVMTQTPLSLPVSLGDRASISCRSGQSLVHSNGNTYLHWYLQKPGQSPKLLIYTVSNRFSGVPDRFSGSGSGSDFTLTISRVEAEDLGVYFCSQNTFVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3875 - protein, 219 aa, Artificial Sequence
  Description of Artificial Sequence: Synthetic polypeptide
DVVMTQTPLSLPVSLGDQASISCRSSQSLVYSNGDTYLHWYLQKPGQSPKLLIYKVSNRFSGVPDRFSGSGSGTDFTLKISRVEAEDLGVYFCSQSTHVPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3876 - protein, 219 aa, Artificial Sequence; identical to SEQ ID NO: 3859
  Description of Artificial Sequence: Synthetic polypeptide

SEQ ID NO: 3877 - protein, 219 aa, Artificial Sequence
  Description of Artificial Sequence: Synthetic polypeptide
DIVMTQSPLSLPVTPGEPASISCRVSQSLLHSNGYTYLHWYLQKPGQSPQLLIYKVSNRFSGVPDRFSGSGSGTDFTLKISRVEAEDVGVYYCSQTRHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3878 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3879 - protein, 219 aa, Artificial Sequence; identical to SEQ ID NO: 3861
  Description of Artificial Sequence: Synthetic polypeptide

SEQ ID NO: 3880 - protein, 239 aa, Artificial Sequence
  Description of Artificial Sequence: Synthetic polypeptide
MDTRAPTQLLGLLLLWLPGATFAQVLTQTPSPVSAAVGGTVTINCQSSQSLYNKNWLSWYQKKPGQPPKLLIYKASTLESGVSSRFKGSGSGTQFTLTISGVQCDDAATYYCQGEFSCSSADCTAFGGGTEVVVKGDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 3881 - protein, 123 aa, Artificial Sequence
  Description of Artificial Sequence: Synthetic polypeptide
DIVMTQTPLSLPVSLGDQASISCRSSQSLESSSGYPHLNWYLQKPGQSPQLLIYRVSNRFSGVLDRFSGSGSGTDFTLQISRVEAEDLGVYFCLQITHVPWTFGGGTKLEIKRADAAPTVSAA

SEQ ID NO: 3882 - protein, 218 aa, Artificial Sequence
  Description of Artificial Sequence: Synthetic polypeptide
DIVMTQTPLSLPVTPGEPASISCRSSQRLVHSHGKTYLHWYLQKPGQSPQLLIYKVSNRFSGVPDRFSGSGSGTDFTLKISRVEAEDVGWFCSQTAHFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3883 - protein, 218 aa, Artificial Sequence
  Description of Artificial Sequence: Synthetic polypeptide
DIVMTQTPLSLPVTPGEPASISCRSSQSLVHSHGKTYLHWYLQKPGQSPQLLIYKVSNRFSGVPDRFSGSGSGTDFTLKISRVEAEDVGWFCSQTAHFPYTFGGGTKVEIKRTVAAPSVFIFPPSDEQLKSGTASVVCLLNNFYPREAKVQWKVDNALQSGNSQESVTEGDSKDSTYSLSSTLTLSKADYEKHKVYACEVTHQGLSSPVTKSFNRGEC

SEQ ID NO: 3884 - protein, 112 aa, Artificial Sequence
  Description of Artificial Sequence: Synthetic polypeptide
DVLMTQTPLSLAVNLGDQASLSCRSSQTILHSNGNTYLEWYLQKPGQSPRLLIYKVSKRFSGVPDRFSGSGSGTDFTLKISRVEADDLGIYYCFQGSLVPWAFGGGTKLEIK

SEQ ID NO: 3885 - protein, 112 aa, Artificial Sequence; identical to SEQ ID NO: 3443
  Description of Artificial Sequence: Synthetic polypeptide

SEQ ID NO: 3886 - protein, 107 aa, Artificial Sequence [sequence omitted]

SEQ ID NO: 3887 - protein, 219 aa, Artificial Sequence
  Description of Artificial Sequence: Synthetic polypeptide
DIVMTQTPLSLPVTPGEPASISCRSSQRLVHSHGKTYLHWYLQKPGQSPQLLIYKVSNRFSGVPDRFSGSGSGTDFTLKISRVEAEDVGVYFCSQTAHFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3888 - protein, 219 aa, Artificial Sequence
  Description of Artificial Sequence: Synthetic polypeptide
DIVMTQTPLSLPVTPGEPASISCRSSQSLVHSHGKTYLHWYLQKPGQSPQLLIYKVSNRFSGVPDRFSGSGSGTDFTLKISRVEAEDVGVYFCSQTAHFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3889 - protein, 441 aa, Artificial Sequence; identical to SEQ ID NO: 3434
  Description of Artificial Sequence: Synthetic polypeptide

SEQ ID NO: 3890 - protein, 106 aa, Artificial Sequence
  Description of Artificial Sequence: Synthetic polypeptide
QIVLTQSPATLSLSPGERATLSCSASSSVSYMHWYQQKPGQSPRLLIYTTSNLASGIPSRFSGSGSGTFYTLTISSLEPEDFAVYYCHQWSSYPWTFGGGTKLEIK

SEQ ID NO: 3891 - protein, 106 aa, Artificial Sequence
  Description of Artificial Sequence: Synthetic polypeptide
QIVLTQSPATLSLSPGERATLSCSASSSVSYMHWYQQKPGQSPRLLIYTTSNLASGIPSRFSGSGSGTDYTLTISSLEPEDAADYYCHQWSSYPWTFGQGTKLEIK

SEQ ID NO: 3892 - protein, 106 aa, Artificial Sequence
  Description of Artificial Sequence: Synthetic polypeptide
EIVLTQSPATLSLSPGEEATLSCSASSSVSYMHWYQQKPGQSPRLLIYTTSNLASGIPSRFSGSGSGTFYTLTISSLEPEDAADYYCHQWSSYPWTFGGGTKLEIK

SEQ ID NO: 3893 - protein, 106 aa, Artificial Sequence
  Description of Artificial Sequence: Synthetic polypeptide
QIVLTQSPATLSLSPGERATLSCSASSSVSYMHWYQQKPGQSPRLLIYTTSNLASGIPSRFSGSGSGTFYTLTISSLEPEDAADYYCHQWSSYPWTFGGGTKLEIK

SEQ ID NO: 3894 - protein, 106 aa, Artificial Sequence
  Description of Artificial Sequence: Synthetic polypeptide
QIVLTQSPATLSLSPGEEATLSCSASSSVSYMHWYQQKSGTSPRLLIYTTSNLASGIPSRFSGSGSGTFYTLTISSLEPEDAADYYCHQWSSYPWTFGGGTKLEIK

SEQ ID NO: 3895 - protein, 106 aa, Artificial Sequence
  Description of Artificial Sequence: Synthetic polypeptide
DIVLSQSPAIMSASLGEEITLTCSASSSVSYMHWYQQKSGTSPKLLITTTSNLASGVPSRFSGSGSGTFYSLTISSVEAEDAADYYCHQWSSYPWTFGGGTKLEIK

SEQ ID NO: 3896 - protein, 106 aa, Artificial Sequence
  Description of Artificial Sequence: Synthetic polypeptide
EIVLTQSPATLSLSPGERATLSCSASSSVSYMHWYQQKPGQAPRLLIYTTSNLASGIPARFSGSGSGTDFTLTISSLEPEDFAVYYCHQWSSYPWTFGQGTKLEIK

SEQ ID NO: 3897 - protein, 106 aa, Artificial Sequence
  Description of Artificial Sequence: Synthetic polypeptide
EIVLTQSPATLSLSPGERATLSCSASSSVSYMHWYQQKPGQSPRLLIYTTSNLASGIPSRFSGSGSGTDFTLTISSLEPEDAADYYCHQWSSYPWTFGQGTKLEIK

SEQ ID NO: 3898 - protein, 106 aa, Artificial Sequence; identical to SEQ ID NO: 3890
  Description of Artificial Sequence: Synthetic polypeptide

SEQ ID NO: 3899 - protein, 219 aa, Artificial Sequence; identical to SEQ ID NO: 3861
  Description of Artificial Sequence: Synthetic polypeptide

SEQ ID NO: 3900 - protein, 215 aa, Artificial Sequence; identical to SEQ ID NO: 3858
  Description of Artificial Sequence: Synthetic polypeptide

SEQ ID NO: 3901 - protein, 219 aa, Artificial Sequence
  Description of Artificial Sequence: Synthetic polypeptide
DVVMTQSPLSLPVTLGQPASISCKSSQSLLYSDAKTYLNWFQQRPGQSPRRLIYQISRLDPGVPDRFSGSGSGTDFTLKISRVEAEDVGVYYCLQGTHYPVLFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3902 - protein, 219 aa, Artificial Sequence; identical to SEQ ID NO: 3859
  Description of Artificial Sequence: Synthetic polypeptide

SEQ ID NO: 3903 - protein, 107 aa, Artificial Sequence [sequence omitted]

SEQ ID NO: 3904 - protein, 107 aa, Artificial Sequence [sequence omitted]

SEQ ID NO: 3905 - protein, 214 aa, Artificial Sequence
  Description of Artificial Sequence: Synthetic polypeptide
DIVMTQSQKFMSTSVGDRVSITCKASQNVGTAVAWYQQKPGQSPKLMIYSASNRYTGVPDRFTGSGSGTDFTLTISNMQSEDLADYFCQQYSSYPLTFGAGTKLELKRADAAPTVSIFPPSSEQLTSGGASVVCFLNNFYPKDINVKWKIDGSERQNGVLNSATDQDSKDSTYSMSSTLTLTKDEYERHNSYTCEATHKTSTSPIVKSFNRNEC

SEQ ID NO: 3906 - protein, 213 aa, Artificial Sequence
  Description of Artificial Sequence: Synthetic polypeptide
SYELTQPPSVSVSPGQTARISCFGDTLPKQYTYWYQQKPGQAPVLVIYKDTERPSGIPERFSGSSSGTTVTLTISGVQAEDEADYYCLSADNSATWVFGGGTKVTVLGQPKSSPSVTLFPPSSEELETNKATLVCTITDFYPGVVTVDWKVDGTPVTQGMETTQPSKQSNNKYMASSYLTLTARAWERHSSYSCQVTHEGHTVEKSLSRADCS

SEQ ID NO: 3907 - protein, 92 aa, Artificial Sequence
  Description of Artificial Sequence: Synthetic polypeptide
MSCKSSQSLLNSRTRKNYLAWYQQKPGQSPKLLIYWASTRESGVPDRFTGSGSGTDFTLTISSVQAEDLAVYYCKQSYNLYTFGGGTKLEIK

SEQ ID NO: 3908 - protein, 109 aa, Artificial Sequence; identical to SEQ ID NO: 3562
  Description of Artificial Sequence: Synthetic polypeptide

SEQ ID NO: 3909 - protein, 109 aa, Artificial Sequence; identical to SEQ ID NO: 3562
  Description of Artificial Sequence: Synthetic polypeptide

SEQ ID NO: 3910 - protein, 109 aa, Artificial Sequence; identical to SEQ ID NO: 3611
  Description of Artificial Sequence: Synthetic polypeptide

SEQ ID NO: 3911 - protein, 109 aa, Artificial Sequence; identical to SEQ ID NO: 3609
  Description of Artificial Sequence: Synthetic polypeptide

SEQ ID NO: 3912 - protein, 109 aa, Artificial Sequence; identical to SEQ ID NO: 3562
  Description of Artificial Sequence: Synthetic polypeptide

SEQ ID NO: 3913 - protein, 109 aa, Artificial Sequence; identical to SEQ ID NO: 3562
  Description of Artificial Sequence: Synthetic polypeptide

SEQ ID NO: 3914 - protein, 109 aa, Artificial Sequence; identical to SEQ ID NO: 3611
  Description of Artificial Sequence: Synthetic polypeptide

SEQ ID NO: 3915 - protein, 109 aa, Artificial Sequence; identical to SEQ ID NO: 3591
  Description of Artificial Sequence: Synthetic polypeptide

SEQ ID NO: 3916 - protein, 109 aa, Artificial Sequence; identical to SEQ ID NO: 3562
  Description of Artificial Sequence: Synthetic polypeptide

SEQ ID NO: 3917 - protein, 109 aa, Artificial Sequence; identical to SEQ ID NO: 3591
  Description of Artificial Sequence: Synthetic polypeptide

SEQ ID NO: 3918 - protein, 92 aa, Artificial Sequence; identical to SEQ ID NO: 3907
  Description of Artificial Sequence: Synthetic polypeptide

SEQ ID NO: 3919 - protein, 109 aa, Artificial Sequence
  Description of Artificial Sequence: Synthetic polypeptide
MTQTPLSLPVSLGDQASISCRSSQSLENSNGNTYLNWYLQKPGQSPQLLIYRVSNRFSGVLDRFSGSGSGTDFTLKISRVEAEDLGVYFCLQVTHVPPTFGGGTKLEIK

SEQ ID NO: 3920 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEADDLGVYYCFQGSHVPPTFGGGTKLEIK

SEQ ID NO: 3921 - protein, 109 aa, Artificial Sequence; identical to SEQ ID NO: 3562
  Description of Artificial Sequence: Synthetic polypeptide

SEQ ID NO: 3922 - protein, 109 aa, Artificial Sequence
  Description of Artificial Sequence: Synthetic polypeptide
MTQTPFSLPVSLGDQASISCRSSQSIVHSNGNTYLEWYLQKPGQSPKPLIYKVSNRFSGVPDRFSGSGSGTDFTLKISRVEAEDLGVYYCFQGSHVPLTFGAGTKLELK

SEQ ID NO: 3923 - protein, 109 aa, Artificial Sequence; identical to SEQ ID NO: 3591
  Description of Artificial Sequence: Synthetic polypeptide

SEQ ID NO: 3924 - protein, 109 aa, Artificial Sequence; identical to SEQ ID NO: 3562
  Description of Artificial Sequence: Synthetic polypeptide

SEQ ID NO: 3925 - protein, 93 aa, Artificial Sequence
  Description of Artificial Sequence: Synthetic polypeptide
MSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 3926 - protein, 249 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIKMDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSGGYRYYYAMDYWGQGTSVTVSS

SEQ ID NO: 3927 - protein, 137 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARSRYGNFAYWGQGTLVTVSA

SEQ ID NO: 3928 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLGLKLGNLDYWGQGTTLTVSS

SEQ ID NO: 3929 - protein, 92 aa, Artificial Sequence; identical to SEQ ID NO: 3907
  Description of Artificial Sequence: Synthetic polypeptide

SEQ ID NO: 3930 - protein, 107 aa, Artificial Sequence
  Description of Artificial Sequence: Synthetic polypeptide
MKLSCVASGFTFSNYWMNWVRQSPEKGLEWVAEIRLKSNNYATHYAESVKGRFTISRDDSKSSVYLQMNNLRAEDTGIYYCTRRGPSGYDRAWFAYWGQGTLVTVSA

SEQ ID NO: 3931 - protein, 143 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRAPRLYYGYDAMDYWGQGTSVTVSS

SEQ ID NO: 3932 - protein, 140 aa, Artificial Sequence; identical to SEQ ID NO: 3571
  Description of Artificial Sequence: Synthetic polypeptide

SEQ ID NO: 3933 - protein, 137 aa, Artificial Sequence; identical to SEQ ID NO: 3927
  Description of Artificial Sequence: Synthetic polypeptide

SEQ ID NO: 3934 - protein, 248 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCASYGSSYGGTFDYWGQGTTLTVSSMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 3935 - protein, 109 aa, Artificial Sequence; identical to SEQ ID NO: 3919
  Description of Artificial Sequence: Synthetic polypeptide

SEQ ID NO: 3936 - protein, 109 aa, Artificial Sequence; identical to SEQ ID NO: 3562
  Description of Artificial Sequence: Synthetic polypeptide

SEQ ID NO: 3937 - protein, 109 aa, Artificial Sequence; identical to SEQ ID NO: 3562
  Description of Artificial Sequence: Synthetic polypeptide

SEQ ID NO: 3938 - protein, 109 aa, Artificial Sequence; identical to SEQ ID NO: 3562
  Description of Artificial Sequence: Synthetic polypeptide

SEQ ID NO: 3939 - protein, 109 aa, Artificial Sequence; identical to SEQ ID NO: 3562
  Description of Artificial Sequence: Synthetic polypeptide

SEQ ID NO: 3940 - protein, 92 aa, Artificial Sequence; identical to SEQ ID NO: 3907
  Description of Artificial Sequence: Synthetic polypeptide

SEQ ID NO: 3941 - protein, 109 aa, Artificial Sequence; identical to SEQ ID NO: 3591
  Description of Artificial Sequence: Synthetic polypeptide

SEQ ID NO: 3942 - protein, 109 aa, Artificial Sequence; identical to SEQ ID NO: 3562
  Description of Artificial Sequence: Synthetic polypeptide

SEQ ID NO: 3943 - protein, 109 aa, Artificial Sequence; identical to SEQ ID NO: 3562
  Description of Artificial Sequence: Synthetic polypeptide

SEQ ID NO: 3944 - protein, 109 aa, Artificial Sequence; identical to SEQ ID NO: 3591
  Description of Artificial Sequence: Synthetic polypeptide

SEQ ID NO: 3945 - protein, 109 aa, Artificial Sequence; identical to SEQ ID NO: 3591
  Description of Artificial Sequence: Synthetic polypeptide

SEQ ID NO: 3946 - protein, 109 aa, Artificial Sequence; identical to SEQ ID NO: 3591
  Description of Artificial Sequence: Synthetic polypeptide

SEQ ID NO: 3947 - protein, 109 aa, Artificial Sequence; identical to SEQ ID NO: 3611
  Description of Artificial Sequence: Synthetic polypeptide

SEQ ID NO: 3948 - protein, 109 aa, Artificial Sequence; identical to SEQ ID NO: 3611
  Description of Artificial Sequence: Synthetic polypeptide

SEQ ID NO: 3949 - protein, 109 aa, Artificial Sequence; identical to SEQ ID NO: 3611
  Description of Artificial Sequence: Synthetic polypeptide

SEQ ID NO: 3950 - protein, 109 aa, Artificial Sequence; identical to SEQ ID NO: 3611
  Description of Artificial Sequence: Synthetic polypeptide

SEQ ID NO: 3951 - protein, 109 aa, Artificial Sequence
  Description of Artificial Sequence: Synthetic polypeptide
MTQTPLSLPVSLGDQASISCRSSQGIVHSTGNTYLEWYLQKPGQSPKLLIYKVSNRFSGVPDRFSGSGSGTDFTLKISRVEAEDLGVYYCFQGSHVPLTFGAGTKLELK

SEQ ID NO: 3952 - protein, 109 aa, Artificial Sequence; identical to SEQ ID NO: 3611
  Description of Artificial Sequence: Synthetic polypeptide

SEQ ID NO: 3953 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCATYGIYAMDYWGQGTSVTVSS

SEQ ID NO: 3954 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYGNYGYYAMDYWGQGTSVTVSS

SEQ ID NO: 3955 - protein, 135 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSRGYFDVWGAGTTVTVSS

SEQ ID NO: 3956 - protein, 245 aa, Artificial Sequence
  Description of Artificial Sequence: Synthetic polypeptide
MDSRLNLVFLVLILKGVQCDAQLVESGGGLVQPGGSRKLSCAASGFTFSSFGMHWVRQAPEKGLEWVAYISSGSSTIYYADTVKGRFTISRDNPKNTLFLQMTSLRSEDTAMYYCAIYYYGSSYYWGQGTTLTVSSMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGAGTKLELK

SEQ ID NO: 3957 - protein, 109 aa, Artificial Sequence; identical to SEQ ID NO: 3591
  Description of Artificial Sequence: Synthetic polypeptide

SEQ ID NO: 3958 - protein, 109 aa, Artificial Sequence; identical to SEQ ID NO: 3611
  Description of Artificial Sequence: Synthetic polypeptide

SEQ ID NO: 3959 - protein, 109 aa, Artificial Sequence; identical to SEQ ID NO: 3591
  Description of Artificial Sequence: Synthetic polypeptide

SEQ ID NO: 3960 - protein, 109 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIK

SEQ ID NO: 3961 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGAGTKLELK

SEQ ID NO: 3962 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYHCFQGSHVPLTFGAGTKLELK

SEQ ID NO: 3963 - protein, 109 aa, Artificial Sequence
  Description of Artificial Sequence: Synthetic polypeptide
MAQTPLSLPVSLGDQASISCRSSQRLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 3964 - protein, 247 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELKMDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARRGRYYAMDYWGQGTSVTVSS

SEQ ID NO: 3965 - protein, 139 aa, Artificial Sequence
  Description of Artificial Sequence: Synthetic polypeptide
MYLGLNCVFIVFLLKGVQSEVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRARRGYAMDYWGQGTSVTVSS

SEQ ID NO: 3966 - protein, 100 aa, Artificial Sequence
  Description of Artificial Sequence: Synthetic polypeptide
MSCKASGYTFTSYWMHWVKQRPGQGLEWIGYINPSTGYTEYNQKFKDKATLTADKSSSTAYMQLSSLTSEDSAVYYCDYYGSSYGYFDVWGAGTTVTVSS

SEQ ID NO: 3967 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARSNYVIYYAMDYWGQGTSVTVSS

SEQ ID NO: 3968 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARIGFGYYYAMDYWGQGTSVTVSS

SEQ ID NO: 3969 - protein, 133 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYDGYYWGQGTTLTVSS

SEQ ID NO: 3970 - protein, 135 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARDEGYFDYWGQGTTLTVSS

SEQ ID NO: 3971 - protein, 140 aa, Artificial Sequence; identical to SEQ ID NO: 3597
  Description of Artificial Sequence: Synthetic polypeptide

SEQ ID NO: 3972 - protein, 137 aa, Artificial Sequence
  Description of Artificial Sequence: Synthetic polypeptide
MDRLTSSFLLLIVPAYVLSQVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCASYGKIPFDYWGQGTTLTVSS

SEQ ID NO: 3973 - protein, 109 aa, Artificial Sequence; identical to SEQ ID NO: 3562
  Description of Artificial Sequence: Synthetic polypeptide

SEQ ID NO: 3974 - protein, 138 aa, Artificial Sequence
  Description of Artificial Sequence: Synthetic polypeptide
MDRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRELRLPWFAYWGQGTLVTVS

SEQ ID NO: 3975 - protein, 136 aa, Artificial Sequence
  Description of Artificial Sequence: Synthetic polypeptide
MDSRLNLVFLVLILKGVQCDVQLVESGGGLVQPGGSRNLSCAASGFTFSSFGMHWVRQAPVKGLEWVAYISSGSSTIYYADTVKGRFTISRDNPKNTLFLQMTSLRSEDTAMYYCASDYGSSSFAYWGQGTLVTVS

SEQ ID NO: 3976 - protein, 109 aa, Artificial Sequence
  Description of Artificial Sequence: Synthetic polypeptide
MTQSPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 3977 - protein, 139 aa, Artificial Sequence
  Description of Artificial Sequence: Synthetic polypeptide
MGWSYIILFLVATATGVHSQVQLQQPGAELVKPGASVKLSCKASGYTFTSYYMYWVKQRPGQGLEWIGGINPSNGGTNFNEKFKSKATLTVDKSSSTAYMQLSSLTSEDSAVYYCTRERKIHYYGYDYWGQGTTLTVSS

SEQ ID NO: 3978 - protein, 138 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARIYYGSSGAFAYWGQGTLVTVS

SEQ ID NO: 3979 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGTGAMDYWGQGTSVTVSS

SEQ ID NO: 3980 - protein, 138 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRARRYAMDYWGQGTSVTVSS

SEQ ID NO: 3981 - protein, 136 aa, Artificial Sequence; identical to SEQ ID NO: 3544
  Description of Artificial Sequence: Synthetic polypeptide

SEQ ID NO: 3982 - protein, 135 aa, Artificial Sequence
  Description of Artificial Sequence: Synthetic polypeptide
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARGSNFDYWGQGTTLTVSS

SEQ ID NO: 3983 - protein, 142 aa, Artificial Sequence
  Description of Artificial Sequence: Synthetic polypeptide
MDRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRGVYYRYDDAMDYWGQGTSVTVSS

SEQ ID NO: 3984 - protein, 137 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARGGHVGAMDYWGQGTSVTVSS

SEQ ID NO: 3985 - protein, 109 aa, Artificial Sequence; identical to SEQ ID NO: 3562
  Description of Artificial Sequence: Synthetic polypeptide

SEQ ID NO: 3986 - protein, 141 aa, Artificial Sequence
  Description of Artificial Sequence: Synthetic polypeptide
MDRLTSSFLLLIVPAYVLSQVTLKESGPGILKPPQTLSLTCSFSGFSLSTSGMGVGWIRQPSGKGLEWLAHIWWDDDKYYNPSLKSQLTISKDTSRNQVFLKITSVDTADTATYYCARSATTGTKGTMDYWGQGTSVTVSS

SEQ ID NO: 3987 - protein, 139 aa, Artificial Sequence
  Description of Artificial Sequence: Synthetic polypeptide
MDSRLNLVFLVLILKGVQCDVQLVESGGGLVQPGGSRKLSCAASGFSFSSFGMHWVRQAPEKGLEWVAYISSGRSTIYYADTVKGRFTISRDNPKNTLFLQMTSLRSEDTAMYYCARLRGNLDYAMDYWGQGTSVTVSS

SEQ ID NO: 3988 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARLDGYRGDYWGQGTTLTVSS

SEQ ID NO: 3989 - protein, 147 aa, Artificial Sequence
  Description of Artificial Sequence: Synthetic polypeptide
MNLGLSLIFLVLVLKGVQCEVKLVESGGGLVQPGGSLKLSCATSGFTFSDYYMYWVRQTPEKRLEWVAYISNGGGRTYYPDTVKGRFTISRDNAKNTLYLQMSRLKSEDTAMYYCARGTSYGSGLHYYAMDYWGQGTSVTVSSAKTT

SEQ ID NO: 3990 - protein, 136 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARYYYYAMDYWGQGTSVTVSS

SEQ ID NO: 3991 - protein, 139 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISGGSSTIYYADTVKGRFTISRDNPKNTLFLQMTSLRSKDTAMYYCARSPFLRLQGLAYWGQGTLVTVSA

SEQ ID NO: 3992 - protein, 140 aa, Artificial Sequence
  Description of Artificial Sequence: Synthetic polypeptide
MDRLTSSFLLLIVPAYVLPQVTLKESGPGILKPSQTLSLTCSFSGFSLSTSGMGVGWIRQPSGKGLEWLAHIWWDDDKYYNPSLKSQLTISKDTSRNQVFLKITSVDTADTATYYCARRASRGTDAMDYWGQGTSVTVSS

SEQ ID NO: 3993 - protein, 98 aa, Artificial Sequence; identical to SEQ ID NO: 3554
  Description of Artificial Sequence: Synthetic polypeptide

SEQ ID NO: 3994 - protein, 232 aa, Artificial Sequence
  Description of Artificial Sequence: Synthetic polypeptide
EVQLVESGGDLVKPGGSLKLSCAASGFTFSSYGMSWVRQTPDKRLDWVATISSGGSYTYYPDSVKGRFTISRDNAKNTLYLQMSSLKSEDTAMYYCARSTMIATGTFAYWGQGTLVTVSADVLMTQSPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 3995 - protein, 112 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTKLELK

SEQ ID NO: 3996 - protein, 109 aa, Artificial Sequence; identical to SEQ ID NO: 3562
  Description of Artificial Sequence: Synthetic polypeptide

SEQ ID NO: 3997 - protein, 109 aa, Artificial Sequence; identical to SEQ ID NO: 3591
  Description of Artificial Sequence: Synthetic polypeptide

SEQ ID NO: 3998 - protein, 109 aa, Artificial Sequence; identical to SEQ ID NO: 3562
  Description of Artificial Sequence: Synthetic polypeptide

SEQ ID NO: 3999 - protein, 92 aa, Artificial Sequence
  Description of Artificial Sequence: Synthetic polypeptide
MSCKSSQSLLNSRTRKNYLAWYQQKPGQSPKLLIYWASTRESGVPDRFTGSGSGTDFTLTISSVQAEDLAVYYCKQSYNLPTFGGGTKLEIK

SEQ ID NO: 4000 - protein, 112 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPPTFGGGTKLEIK

SEQ ID NO: 4001 - protein, 111 aa, Artificial Sequence
  Description of Artificial Sequence: Synthetic polypeptide
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPRTFGGGTKLEIK

SEQ ID NO: 4002 - protein, 109 aa, Artificial Sequence; identical to SEQ ID NO: 3961
  Description of Artificial Sequence: Synthetic polypeptide

SEQ ID NO: 4003 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 4004 - protein, 109 aa, Artificial Sequence; identical to SEQ ID NO: 3591
  Description of Artificial Sequence: Synthetic polypeptide

SEQ ID NO: 4005 - protein, 109 aa, Artificial Sequence; identical to SEQ ID NO: 3960
  Description of Artificial Sequence: Synthetic polypeptide

SEQ ID NO: 4006 - protein, 109 aa, Artificial Sequence; identical to SEQ ID NO: 3562
  Description of Artificial Sequence: Synthetic polypeptide

SEQ ID NO: 4007 - protein, 109 aa, Artificial Sequence; identical to SEQ ID NO: 3611
  Description of Artificial Sequence: Synthetic polypeptide

SEQ ID NO: 4008 - protein, 109 aa, Artificial Sequence; identical to SEQ ID NO: 4003
  Description of Artificial Sequence: Synthetic polypeptide

SEQ ID NO: 4009 - protein, 109 aa, Artificial Sequence; identical to SEQ ID NO: 3562
  Description of Artificial Sequence: Synthetic polypeptide

SEQ ID NO: 4010 - protein, 92 aa, Artificial Sequence; identical to SEQ ID NO: 3907
  Description of Artificial Sequence: Synthetic polypeptide

SEQ ID NO: 4011 - protein, 109 aa, Artificial Sequence
  Description of Artificial Sequence: Synthetic polypeptide
MTQTPLSLPVSLGDQASISCRSSQSLVHSNGNTYLHWYLQKPGQSPKLLIYKVSNRSSGVPDRFSGSGSGTDFTLKISRVEAEDLGVYFCSQSTHVPPTFGGGTKLEIK

SEQ ID NO: 4012 - protein, 109 aa, Artificial Sequence
  Description of Artificial Sequence: Synthetic polypeptide
MTQTPLTLSVTIGQPASISCKSSQSLLYSNGKTYLNWLLQRPGQSPKRLIYLVSKLDSGVPDRFTGSGSGTDFTLKISRVEAEDLGVYYCVQGTHFPFMFGSGTKLEIK

SEQ ID NO: 4013 - protein, 109 aa, Artificial Sequence; identical to SEQ ID NO: 3960
  Description of Artificial Sequence: Synthetic polypeptide

SEQ ID NO: 4014 - protein, 109 aa, Artificial Sequence; identical to SEQ ID NO: 3562
  Description of Artificial Sequence: Synthetic polypeptide

SEQ ID NO: 4015 - protein, 109 aa, Artificial Sequence; identical to SEQ ID NO: 3562
  Description of Artificial Sequence: Synthetic polypeptide

SEQ ID NO: 4016 - protein, 109 aa, Artificial Sequence; identical to SEQ ID NO: 3919
  Description of Artificial Sequence: Synthetic polypeptide

SEQ ID NO: 4017 - protein, 109 aa, Artificial Sequence; identical to SEQ ID NO: 3562
  Description of Artificial Sequence: Synthetic polypeptide

SEQ ID NO: 4018 - protein, 109 aa, Artificial Sequence; identical to SEQ ID NO: 3562
  Description of Artificial Sequence: Synthetic polypeptide

SEQ ID NO: 4019 - protein, 109 aa, Artificial Sequence; identical to SEQ ID NO: 3562
  Description of Artificial Sequence: Synthetic polypeptide

SEQ ID NO: 4020 - protein, 109 aa, Artificial Sequence; identical to SEQ ID NO: 3960
  Description of Artificial Sequence: Synthetic polypeptide

SEQ ID NO: 4021 - protein, 109 aa, Artificial Sequence; identical to SEQ ID NO: 3562
  Description of Artificial Sequence: Synthetic polypeptide

SEQ ID NO: 4022 - protein, 109 aa, Artificial Sequence; identical to SEQ ID NO: 3562
  Description of Artificial Sequence: Synthetic polypeptide

SEQ ID NO: 4023 - protein, 109 aa, Artificial Sequence; identical to SEQ ID NO: 3562
  Description of Artificial Sequence: Synthetic polypeptide

SEQ ID NO: 4024 - protein, 109 aa, Artificial Sequence; identical to SEQ ID NO: 3609
  Description of Artificial Sequence: Synthetic polypeptide

SEQ ID NO: 4025 - protein, 109 aa, Artificial Sequence; identical to SEQ ID NO: 3562
  Description of Artificial Sequence: Synthetic polypeptide

SEQ ID NO: 4026 - protein, 109 aa, Artificial Sequence; identical to SEQ ID NO: 3562
  Description of Artificial Sequence: Synthetic polypeptide

SEQ ID NO: 4027 - protein, 109 aa, Artificial Sequence; identical to SEQ ID NO: 3562
  Description of Artificial Sequence: Synthetic polypeptide

SEQ ID NO: 4028 - protein, 109 aa, Artificial Sequence; identical to SEQ ID NO: 3591
  Description of Artificial Sequence: Synthetic polypeptide

SEQ ID NO: 4029 - protein, 109 aa, Artificial Sequence; identical to SEQ ID NO: 3562
  Description of Artificial Sequence: Synthetic polypeptide

SEQ ID NO: 4030 - protein, 92 aa, Artificial Sequence; identical to SEQ ID NO: 3907
  Description of Artificial Sequence: Synthetic polypeptide

SEQ ID NO: 4031 - protein, 109 aa, Artificial Sequence; identical to SEQ ID NO: 3562
  Description of Artificial Sequence: Synthetic polypeptide

SEQ ID NO: 4032 - protein, 109 aa, Artificial Sequence; identical to SEQ ID NO: 3591
  Description of Artificial Sequence: Synthetic polypeptide

SEQ ID NO: 4033 - protein, 121 aa, Artificial Sequence
  Description of Artificial Sequence: Synthetic polypeptide
MFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 4034 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGSGTKLEIK

SEQ ID NO: 4035 - protein, 109 aa, Artificial Sequence; identical to SEQ ID NO: 3562
  Description of Artificial Sequence: Synthetic polypeptide

SEQ ID NO: 4036 - protein, 109 aa, Artificial Sequence; identical to SEQ ID NO: 3591
  Description of Artificial Sequence: Synthetic polypeptide

SEQ ID NO: 4037 - protein, 109 aa, Artificial Sequence; identical to SEQ ID NO: 3960
  Description of Artificial Sequence: Synthetic polypeptide

SEQ ID NO: 4038 - protein, 109 aa, Artificial Sequence; identical to SEQ ID NO: 3562
  Description of Artificial Sequence: Synthetic polypeptide

SEQ ID NO: 4039 - protein, 109 aa, Artificial Sequence; identical to SEQ ID NO: 3562
  Description of Artificial Sequence: Synthetic polypeptide

SEQ ID NO: 4040 - protein, 109 aa, Artificial Sequence; identical to SEQ ID NO: 3562
  Description of Artificial Sequence: Synthetic polypeptide

SEQ ID NO: 4041 - protein, 109 aa, Artificial Sequence; identical to SEQ ID NO: 3562
  Description of Artificial Sequence: Synthetic polypeptide

SEQ ID NO: 4042 - protein, 109 aa, Artificial Sequence; identical to SEQ ID NO: 3591
  Description of Artificial Sequence: Synthetic polypeptide

SEQ ID NO: 4043 - protein, 109 aa, Artificial Sequence; identical to SEQ ID NO: 3611
  Description of Artificial Sequence: Synthetic polypeptide

SEQ ID NO: 4044 - protein, 109 aa, Artificial Sequence; identical to SEQ ID NO: 3562
  Description of Artificial Sequence: Synthetic polypeptide

SEQ ID NO: 4045 - protein, 109 aa, Artificial Sequence; identical to SEQ ID NO: 3562
  Description of Artificial Sequence: Synthetic polypeptide

SEQ ID NO: 4046 - protein, 109 aa, Artificial Sequence; identical to SEQ ID NO: 3562
  Description of Artificial Sequence: Synthetic polypeptide

SEQ ID NO: 4047 - protein, 109 aa, Artificial Sequence; identical to SEQ ID NO: 3562
  Description of Artificial Sequence: Synthetic polypeptide

SEQ ID NO: 4048 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGSGTKLEIK

SEQ ID NO: 4049 - protein, 109 aa, Artificial Sequence; identical to SEQ ID NO: 3562
  Description of Artificial Sequence: Synthetic polypeptide

SEQ ID NO: 4050 - protein, 109 aa, Artificial Sequence; identical to SEQ ID NO: 3960
  Description of Artificial Sequence: Synthetic polypeptide

SEQ ID NO: 4051 - protein, 109 aa, Artificial Sequence
  Description of Artificial Sequence: Synthetic polypeptide
MTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKVEIK

SEQ ID NO: 4052 - protein, 112 aa, Artificial Sequence
  Description of Artificial Sequence: Synthetic polypeptide
DIVMTQSPLSLPVTPGEPASISCRSSQSLVYSNGDTYLHWYLQKPGQSPKLLIYKVSNRFSGVPDRFSGSGSGTDFTLKISRVEAEDVGVYYCSQSTHVPWTFGGGTKVEIK

SEQ ID NO: 4053 - protein, 80 aa, Artificial Sequence
  Description of Artificial Sequence: Synthetic polypeptide
ELVMTQSPLSLPVTPGEPASISCWYLQKPGQSPQLLIYGVPDRFSGSGSGTDFTLKISRVEAEDVGVYYCFGGGTKVEIK

SEQ ID NO: 4054 - protein, 134 aa, Artificial Sequence
  Description of Artificial Sequence: Synthetic polypeptide
MDMRVPAQLLGLLLLWFPGSRCDIVMTQSPLSLPVTPGEPASISCRSSQSLVYSNGDTYLHWYLQKPGQSPKLLIYKVSNRFSGVPDRFSGSGSGTDFTLKISRVEAEDVGVYYCSQSTHVPWTFGGGTKVEIK

SEQ ID NO: 4055 - protein, 113 aa, Artificial Sequence
  Description of Artificial Sequence: Synthetic polypeptide
DIVMTQSPLSLPVTPGEPASISCRSSQSLVYSNGDTYLHWYLQKPGQSPKLLIYKVSNRFSGVPDRFSGSGSGTDFTLKISRVEAEDVGVYYCSQSTHVPWTFGGGTKVEIKR

SEQ ID NO: 4056 - protein, 113 aa, Artificial Sequence
  Description of Artificial Sequence: Synthetic polypeptide
DIVMTQSPLSLPVTPGEPASISCRSSQSVVQSNGNTYLEWYLQKPGQSPQLLIYKVSNRFSGVPDRFSGSGSGTDFTLKISRVEAEDVGVYYCFQGSHVPPTFGGGTKVEIKR

SEQ ID NO: 4057 - protein, 113 aa, Artificial Sequence
  Description of Artificial Sequence: Synthetic polypeptide
DVLVTQSPLSLPVTPGEPASISCRSTQTLVHRNGDTYLEWYLQKPGQSPQSLIYKVSNRFSGVPDRFSGSGSGTDFTLKISRVEAEDVGVYYCFQGSHVPYTFGQGTKLEIKR

SEQ ID NO: 4058 - protein, 112 aa, Artificial Sequence
  Description of Artificial Sequence: Synthetic polypeptide
DVVMTQTPLSLPVTPGQPASISCRSSQSILHSNGNTYLEWYLQKPGQSPQLLIYKVSNRFSGVPDRFSGSGSGTDFTLKISRVEAEDVGVYYCLQTTRVPLTFGQGTKLEIK

SEQ ID NO: 4059 - protein, 219 aa, Artificial Sequence
  Description of Artificial Sequence: Synthetic polypeptide
DVVMTQTPLSLPVTPGQPASISCRSSQSILHSNGNTYLEWYLQKPGQSPQLLIYKVSNRFSGVPDRFSGSGSGTDFTLKISRVEAEDVGVYYCLQTTRVPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4060 - protein, 113 aa, Artificial Sequence
  Description of Artificial Sequence: Synthetic polypeptide
  MOD_RES (2)..(2): Any amino acid
  MOD_RES (7)..(7): Any amino acid
  MOD_RES (14)..(15): Any amino acid
  MOD_RES (30)..(30): Any amino acid
  MOD_RES (50)..(50): Any amino acid
  MOD_RES (88)..(88): Any amino acid
  MOD_RES (105)..(105): Any amino acid
  MOD_RES (108)..(109): Any amino acid
DXVMTQXPLSLPVXXGQPASISCRSSQSLXYSDGNAYLHWFLQKPGQSPXLLIYKVSNRFSGVPDRFSGSGSGTDFTLKISRVEAEDXGVYYCSQSTHVPWTFGXGTXXEIKR

SEQ ID NO: 4061 - protein, 113 aa, Artificial Sequence
  Description of Artificial Sequence: Synthetic polypeptide
DVVMTQSPLSLPVTLGQPASISCRSSQSLIYSDGNAYLHWFLQKPGQSPRLLIYKVSNRFSGVPDRFSGSGSGTDFTLKISRVEAEDVGVYYCSQSTHVPWTFGQGTKVEIKR

SEQ ID NO: 4062 - protein, 112 aa, Artificial Sequence
  Description of Artificial Sequence: Synthetic polypeptide
DIVMTQSPLSLPVTPGEPASISCRSSQSLVYSNGDTYLHWYLQKPGQSPQLLIYKVSNRFSGVPDRFSGSGSGTDFTLKISRVEAEDVGVYYCSQSTHVPWTFGQGTKVEIK

SEQ ID NO: 4063 - protein, 112 aa, Artificial Sequence; identical to SEQ ID NO: 4062
  Description of Artificial Sequence: Synthetic polypeptide

SEQ ID NO: 4064 - protein, 111 aa, Artificial Sequence
  Description of Artificial Sequence: Synthetic polypeptide
QSALTQPPSASGSPGQSVTISCTGTSGDVGRNNYVSWYQHHPGKAPKLMIYDVSKRPSGVSNRFSGSKSGNTASLTISGLQAEDEADYYCSSYTSSSTWVFGGGTKLTVLG

SEQ ID NO: 4065 - protein, 110 aa, Artificial Sequence
  Description of Artificial Sequence: Synthetic polypeptide
QTVVTQEPAVSVALGQTVTITCQGDSLRRYYASWYQQKPGQAPVLVVYGKNKRPSRIPARFSASSSRNTASLTIHGARAEDEADYYCESRDISGNHLYVFGTGTKVTVLG

SEQ ID NO: 4066 - protein, 109 aa, Artificial Sequence
  Description of Artificial Sequence: Synthetic polypeptide
ETTLTQSPRTLSLSPGQRATLSCRASQSVSSSYLAWYQQKPGQAPRLLIYGASSRATGIPDRFRGSGSGTLFTLTISRLEPEDFAVYYCQQFSSSRYIFGQGTKLEIKR

SEQ ID NO: 4067 - protein, 108 aa, Artificial Sequence
  Description of Artificial Sequence: Synthetic polypeptide
QAVLTQPSGTPGQRVTLSCSGSSSNIGSNTVYWYRQLPGTAPRLLIYSYNQRPSGVPDRFSGSKSGTSASLAISGLRSEDEADYYCAAWDDSLSGYVFGTGTKVTVLG

SEQ ID NO: 4068 - protein, 110 aa, Artificial Sequence
  Description of Artificial Sequence: Synthetic polypeptide
QTVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGVRVFGGGTKLTVLG

SEQ ID NO: 4069 - protein, 111 aa, Artificial Sequence
  Description of Artificial Sequence: Synthetic polypeptide
LPVLTQPPSASGTPGQRVTISCSGSSSNIGTNYVYWYQQLPGTAPKLLIYRNNQRPSGVPDRFSGSKSGTSDSLAISGLRSEDEADYYCAVWDASLRGWLFGGGTQLTVLG

SEQ ID NO: 4070 - protein, 109 aa, Artificial Sequence
  Description of Artificial Sequence: Synthetic polypeptide
SSELTQDPNVSVALGQTVRITCQGDTLRNNFPTWYQQKPGQAPVLVFYGKDNRPSGIPDRFSGSRSGTTASLVITGAQAQDEADYYCNSRDSGGHHLVFGGGTKLTVLG

SEQ ID NO: 4071 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKDNRPSGIPDRFSGSSSGNAASLTITGAQAEDEADYYCNSRDTSGNHLVFGGGTKVTVLG

SEQ ID NO: 4072 - protein, 109 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGGGTKLTVLG

SEQ ID NO: 4073 - protein, 109 aa, Artificial Sequence
  Description of Artificial Sequence: Synthetic polypeptide
SSELTQDPAVSVALGQTIRITCQGDSLRSYYASWYQQKPGQAPVLVIYGKNKRPSGIPDRISGSRSGNTASLTITGAQAEDEADYYCNSRDSSGNHLVFGGGTQLTVLG

SEQ ID NO: 4074 - protein, 110 aa, Artificial Sequence
  Description of Artificial Sequence: Synthetic polypeptide
QYELTQPPSVSGTPGQRVTISCSGSSSNIGSEYVYWFQQLPGTAPRLLIYRNDQRPSGVPDRFSGSKSGTSASLAISGLQSEDEADYYCAAWDDSLPGWCFGGGTKLTVL

SEQ ID NO: 4075 - protein, 110 aa, Artificial Sequence
  Description of Artificial Sequence: Synthetic polypeptide
QSELTQPPSASGTPGQRVTISCSGSSSNIGSNTVNWYQQLPGTAPKLLIYNNNQRPSGVPDRFSGSKSGTSASLAISGLQSEDEADYYCAAWHDGLNGPVFGGGTKLTVL

SEQ ID NO: 4076 - protein, 108 aa, Artificial Sequence
  Description of Artificial Sequence: Synthetic polypeptide
QDIQMTQSPATLSLSPGERATLSCKASQSVRAFIAWYQQKPGQAPRLLISGASNRATGIPDRFSGGGSGTDFTLTISRLEPEDFAVYYCQQYGSSRYTFGQGTKLEIK

SEQ ID NO: 4077 - protein, 112 aa, Artificial Sequence
  Description of Artificial Sequence: Synthetic polypeptide
QDIQMTQSPSSLPVTPGEPASISCRSSQSLLHSSGYNYLDWYLQKPGQSPQLLIYLGSNRASGVPDRFTGSGSGTDFTLKISRVEAEDVGVYYCMQALQTPTFGGGTKVDIK

SEQ ID NO: 4078 - protein, 108 aa, Artificial Sequence
  Description of Artificial Sequence: Synthetic polypeptide
QDIQMTQSPATLSVSPGERATLSCRASQSVSSNLAWYQQKPGQAPRLLIYGASTRATGVPARFSGSGSGTDFTLSISSLQPEDFATYYCQQYAGHPITFGQGTRLEIK

SEQ ID NO: 4079 - protein, 105 aa, Artificial Sequence
  Description of Artificial Sequence: Synthetic polypeptide
QSELTQAASVSGSPGQSITLSCTGATRDVSWYQQHPGKAPKLVLYEVSSRPSGVSDRFSGSMSGNTASLTISGLQAEDEADYYCSSTTSRAPRVVFGGGTKLTVL

SEQ ID NO: 4080 - protein, 113 aa, Artificial Sequence
  Description of Artificial Sequence: Synthetic polypeptide
QDIQMTQSPLSLPVTPGEPASISCRSSQSLMHRNGHHFFDWYLQKPGQSPQLLIYWASNRAPGVPDRFSGSGSGTDFTLKISRVEAEDVGIYYCMQALQTPYTFGQGTKLEIK

SEQ ID NO: 4081 - protein, 108 aa, Artificial Sequence
  Description of Artificial Sequence: Synthetic polypeptide
QDIQMTQSPSSLSASIGDRVTISCQASQNIDNYLNWYQQKPGKAPKLLIYAASSLQSGVPSRFSGSGSGTDFTLTISSLQPEDFATYYCQQSYSTPRTFGQGTKVEIK

SEQ ID NO: 4082 - protein, 110 aa, Artificial Sequence
  Description of Artificial Sequence: Synthetic polypeptide
QSELTQPPSASGTPGQRVTISCSGSSSNIGSNYVYWYQQLPGTAPKLLIYRNNQRPSGVPDRFSGSKSGTSASLAISGLQSEDEADYYCAAWDDSLNAWVFGGGTKLTVL

SEQ ID NO: 4083 - protein, 112 aa, Artificial Sequence
  Description of Artificial Sequence: Synthetic polypeptide
QDIQMTQSPLSLPVTPGEPASISCKSSQSLLHSNGYNYLDWYLQKPGQSPQLLISLGSNRASGVPARFSGSGSGTDFTLKISRVEAEDVGVYYCMQALQTITFGQGTRLEIK

SEQ ID NO: 4084 - protein, 108 aa, Artificial Sequence
  Description of Artificial Sequence: Synthetic polypeptide
QDIQMTQSPSTLSASVGDRVTITCRASQSISRWLAWYQQKPGKAPKLLIYAASSLQSGVPSRFSGSGSGTDFTLTISSLQPEDFATYYCQQSYSTPLTFGGGTKVEIK

SEQ ID NO: 4085 - protein, 106 aa, Artificial Sequence
  Description of Artificial Sequence: Synthetic polypeptide
QSALTQPPSVSVSPGQTASITCAGDELGNKYASWYQQKPGQSPVLVIYQDRKRPSGIPERFSGSHSGNTATLTISGTQALDEADYYCQSWDSSSVIFGGGTKVTVL

SEQ ID NO: 4086 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTEFSLSISSLQPEDFATYYCQQANSFPLTFGGGTKVEIK

SEQ ID NO: 4087 - protein, 110 aa, Artificial Sequence
  Description of Artificial Sequence: Synthetic polypeptide
QYELTQPPSASGSPGQSVTISCTGTSSDVGGYNYVSWYQQHPGKAPKFMIYEVNKRPSGVPDRFSGSKSGNTASLTVSGLQAEDEADYYCSSYAGRNFVVFGGGTKLTVL

SEQ ID NO: 4088 - protein, 108 aa, Artificial Sequence
  Description of Artificial Sequence: Synthetic polypeptide
QSALTQPPSVSVAPGQTARITCGGNNIGTKIVNWYQQRPGQAPVVVVYDNSDRPSGIPERFSGSNSGNTATLTISRVEAGDEADYYCQLWDSSSDHPIFGTGTKVTVL

SEQ ID NO: 4089 - protein, 110 aa, Artificial Sequence
  Description of Artificial Sequence: Synthetic polypeptide
QDIQMTQSPGTLSLSPGERATLSCRASQSIGSRYLAWYQQKPGQAPRLLIYDASKRATGVPVRFSGSGSGTDFTLTISSLGPEDFAVYYCQQGYNWPPWTFGQGTKVEIK

SEQ ID NO: 4090 - protein, 108 aa, Artificial Sequence
  Description of Artificial Sequence: Synthetic polypeptide
QDIQMTQSPSSLSASVGDRVTITCRTSQDIRNHLGWFQQKPGKAPQRLIREASILQSGVPSTFYGSGYGREFTLTISSLQPEDFATYYCLQYDSFPYTFGQGTKVEIK

SEQ ID NO: 4091 - protein, 110 aa, Artificial Sequence; identical to SEQ ID NO: 4089
  Description of Artificial Sequence: Synthetic polypeptide

SEQ ID NO: 4092 - protein, 107 aa, Artificial Sequence
  Description of Artificial Sequence: Synthetic polypeptide
DIVMTQSPSSMSASVGDRVTITCKASQNVGTNVAWYQQKPGKAPKPLIYSASYRYSGVPDRFTGSGSGTDFTLTISSLQAEDVAEYFCQQFNSYPLTFGGGTKVEIK

SEQ ID NO: 4093 - protein, 107 aa, Artificial Sequence
  Description of Artificial Sequence: Synthetic polypeptide
DIVMTQSPSFMSASVGDRVTITCKASQNVGTNVAWYQQKPGKAPKPLIYSASYRYSGVPDRFTGSGSGTDFTLTISSLQSEDVAEYFCQQFNSYPLTFGGGTKVEIK

SEQ ID NO: 4094 - protein, 107 aa, Artificial Sequence
  Description of Artificial Sequence: Synthetic polypeptide
DIVMTQSPSSMSASVGDRVTITCKASQNVGTNVAWYQQKPGKAPKPLIYSASYRYSGVPDRFSGSGSGTDFTLTISSLQAEDVAEYFCQQFNSYPLTFGGGTKVEIK

SEQ ID NO: 4095 - protein, 107 aa, Artificial Sequence
  Description of Artificial Sequence: Synthetic polypeptide
DIQMTQSPSSMSASVGDRVTITCKASQNVGTNVAWYQQKPGKAPKPLIYSASYRYSGVPDRFSGSGSGTDFTLTISSLQAEDVAEYFCQQFNSYPLTFGGGTKVEIK

SEQ ID NO: 4096 - protein, 130 aa, Artificial Sequence
  Description of Artificial Sequence: Synthetic polypeptide
MKLPVRLLVLMFWIPASSSDVVMTQTPLSLPVSLGDQASISCRSSQSLVHSDGNTYLHWYLQKPGQSPKLLIYKVSNRFSGVPDRFSGSGSGTDFTLKISRVEAEDLGVYFCSQSTHVWTFGGGTKLGIK

SEQ ID NO: 4097 - protein, 121 aa, Artificial Sequence
  Description of Artificial Sequence: Synthetic polypeptide
MFWIPASSSDVVMTQTPLSLPVSLGDQASISCRSSQSLVHSNGNTFFHWFLQKPGQSPKLLIYKVSNRFSGVPDRFSGSGSGTDFTLKISRVEAEDLGVYFCSQSAHVPWTFGGGTKLEIK

SEQ ID NO: 4098 - protein, 131 aa, Artificial Sequence
  Description of Artificial Sequence: Synthetic polypeptide
MKLPVRLLVLMFWIPASRCDVVMTQTPLSLPVSLGDQASISCRSSQSLIYSDGNAYLHWFLQKPGQSPKLLIYKVSNRFSGVPDRFSGSGSGTDFTLKISRVETEDLGVYFCSQSTHVPWTFGGGTKLEIK

SEQ ID NO: 4099 - protein, 131 aa, Artificial Sequence
  Description of Artificial Sequence: Synthetic polypeptide
MKLPVRLLVLMFWIPASSSDVLMTQTPLSLPVSLGDQASISCRSSQSIVHSNGNTYLEWYLQKPGQSPKLLIYKVSNRFSGVPDRFSGSGSGTDFTLKISRVEAEDLGIYYCFQSSHVPLTFGAGTKLELK

SEQ ID NO: 4100 - protein, 139 aa, Artificial Sequence
  Description of Artificial Sequence: Synthetic polypeptide
MDRLTTSFLLLIVPAYVLSQVTLKESGPGILKPSQTLSLTCSFSGFSLSTSGMSVGWIRQPSGKGLEWLAHIWWDDDKYYNPSLKSRLTISKDTSRNQVFLKITSVDTADTATYYCARRTTTADYFAYWGQGTTLTVSS

SEQ ID NO: 4101 - protein, 112 aa, Artificial Sequence
  Description of Artificial Sequence: Synthetic polypeptide
DVVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQSSHVPLTFGQGTKLEIK

SEQ ID NO: 4102 - protein, 112 aa, Artificial Sequence [sequence omitted]

SEQ ID NO: 4103 - protein, 112 aa, Artificial Sequence; identical to SEQ ID NO: 4101
  Description of Artificial Sequence: Synthetic polypeptide

SEQ ID NO: 4104 - protein, 112 aa, Artificial Sequence
  Description of Artificial Sequence: Synthetic polypeptide
YVVMTQSPLSLPVTPGEPASISCKSSQSLLDSDGKTYLNWLLQKPGQSPQRLIYLVSKLDSGVPDRFSGSGSGTDFTLKISRVEAEDVGVYYCWQGTHFPRTFGQGTKVEIK

SEQ ID NO: 4105 - protein, 120 aa, Artificial Sequence; identical to SEQ ID NO: 3700
  Description of Artificial Sequence: Synthetic polypeptide

SEQ ID NO: 4106 - protein, 112 aa, Artificial Sequence
  Description of Artificial Sequence: Synthetic polypeptide
DIVMTQTPLSLSVTPGQPASISCSSSQSLIYSDGNAYLHWYLQKPGQSPQLLIYKVSNRFSGVPDRFSGSGSGTDFTLKISRVEAEDVGVYYCTQSTHSPWTFGGGTKVEIK

SEQ ID NO: 4107 - protein, 108 aa, Artificial Sequence
  Description of Artificial Sequence: Synthetic polypeptide
DVVMTQSPSSLSASVGDRVTITCRESQGIRNYLAWYQQKPGKAPKLLIYAASTLQSGVPSRFSGSLLGGKAALTLSGVQPEDFATYYCQQANSFPLTFGGGTKVEIKR

SEQ ID NO: 4108 - protein, 108 aa, Artificial Sequence
  Description of Artificial Sequence: Synthetic polypeptide
DVVMTQSPSSLSASVGDRVTITCRESQGIRNYLAWYQQKPGKAPKLLIYKVSNRFSGVPDRFSGSLLGGKAALTLSGVQPEDFATYYCQQANSFPLTFGGGTKVEIKR

SEQ ID NO: 4109 - protein, 108 aa, Artificial Sequence
  Description of Artificial Sequence: Synthetic polypeptide
DVVMTQSPSSLSASVGDRVTITCRESQGIRNYLAWYQQKPGKAPKLLIYWASTRESGVPDRFSGSLLGGKAALTLSGVQPEDFATYYCQQANSFPLTFGGGTKVEIKR

SEQ ID NO: 4110 - protein, 108 aa, Artificial Sequence
  Description of Artificial Sequence: Synthetic polypeptide
EIVLTQSPATLSLSPGERVTITCRASQSVNSYLAWYQQKPGQAPRLLIYGASTRATGIPDRFSGSGSGTDFTLTISRLEPEDFAVYYCQQYGSSQGTFGPGTKVDIKR

SEQ ID NO: 4111 - protein, 108 aa, Artificial Sequence
  Description of Artificial Sequence: Synthetic polypeptide
EIVLTQSPATLSLSPGERVTITCRESQGIRNYLAWYQQKPGQAPRLLIYAASSRATGIPDRFSGSGSGTDFTLTISRLEPEDFAVYYCQQYGSSQGTFGPGTKVDIKR

SEQ ID NO: 4112 - protein, 111 aa, Artificial Sequence
  Description of Artificial Sequence: Synthetic polypeptide
LPVLTQPPSASALLGASIKLTCTLSSEHSTYTIEWYQQRPGRSPQYIMKVKSDGSHSKGDGIPDRFMGSSSGADRYLTFSNLQSDDEAEYHCGESHTIDGQCWVFGGGTKL

SEQ ID NO: 4113 - protein, 108 aa, Artificial Sequence
  Description of Artificial Sequence: Synthetic polypeptide
DIQMTQSPATLSLSPGERAALSCRASQSVNSYLAWYQQKPGQAPRLLIYGAASRATGIPARFSGSGSGTDFTLTISRLEPEDFAVYYCQQYGSSQGTFGPGTKVDIKR

SEQ ID NO: 4114 - protein, 108 aa, Artificial Sequence
  Description of Artificial Sequence: Synthetic polypeptide
EIVLTQSPATLSLSPGERVTITCRESQGIRNYLAWYQQKPGQAPRLLIYGASTRATGIPDRFSGSGSGTDFTLTISRLEPEDFAVYYCQQYGSSQGTFGPGTKVDIKR

SEQ ID NO: 4115 - protein, 108 aa, Artificial Sequence
  Description of Artificial Sequence: Synthetic polypeptide
EIVMTQSPATLSLSPGERVTITCRESQGIRNYLAWYQQKPGQAPRLLIYAASTLQSGVPSRFSGSGSGTDFTLTISRLEPEDFAVYYCQQYGSSQGTFGPGTKVDIKR

SEQ ID NO: 4116 - protein, 108 aa, Artificial Sequence
  Description of Artificial Sequence: Synthetic polypeptide
DVVMTQSPSSLSASVGDRVTITCRESQGIRNYLAWYQQKPGKAPKLLIYKASSLQSGVPSRFSGSLLGGKAALTLSGVQPEDFATYYCQQANSFPLTFGGGTKVEIKR

SEQ ID NO: 4117 - protein, 108 aa, Artificial Sequence
  Description of Artificial Sequence: Synthetic polypeptide
DIVLTQSPATLSLSPGERVTITCRASQSVNSYLAWYQQKPGQAPRLLIYGASTRATGIPDRFSGSGSGTDFTLTISRLEPEDFAVYYCQQYGSSQGTFGPGTKVDIKR

SEQ ID NO: 4118 - protein, 108 aa, Artificial Sequence
  Description of Artificial Sequence: Synthetic polypeptide
DIQMTQSPGTLSLSPGERAALSCRASQSVSSYLAWYQQKPGQAPRLLIYAASIRATGIPDRFSGSGSGTDFTLTISRLEPEDFAVYYCQQYGSSQGTFGPGTKVDIKR

SEQ ID NO: 4119 - protein, 120 aa, Artificial Sequence
  Description of Artificial Sequence: Synthetic polypeptide
EVQLVESGGGVVQPGGSLRLSCAASGFTFRSYWMSWVRQAPGKGLEWVASVKQDGSEKYYVDSVKGRFTISRDTSKNTLYLQMNSLRAEDTAVYYCARDASSWYRDWFDPWGQGTLVTVS

SEQ ID NO: 4120 - protein, 131 aa, Artificial Sequence
  Description of Artificial Sequence: Synthetic polypeptide
MKLPVRLLVLMFWIPASSSDVLMTQTPLSLPVSLGDQASISCRSSQNIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 4121 - protein, 120 aa, Artificial Sequence; identical to SEQ ID NO: 3721
  Description of Artificial Sequence: Synthetic polypeptide

SEQ ID NO: 4122 - protein, 100 aa, Artificial Sequence
  Description of Artificial Sequence: Synthetic polypeptide
DIVMTQSPLSLPVTPGEPASISCRSSQSLLHRYGYNYLDWYLQKPGQSPQLLIYLGSNRASGVPDRFSGSGSGTDFTLKISRVEAEDVGVYYCMQALQTP

SEQ ID NO: 4123 - protein, 132 aa, Artificial Sequence
  Description of Artificial Sequence: Synthetic polypeptide
MRLPAQLLGLLMLWVSGSSGDVVMTQSPLSLPVTPGEPASISCRSSQNIVHSNGNTYLEWYLQKPGQSPQLLIYKVSNRFSGVPDRFSGSGSGTDFTLKISRVEAEDVGVYYCFQGSHVPLTFGQGTKLEIK

SEQ ID NO: 4124 - protein, 107 aa, Artificial Sequence
  Description of Artificial Sequence: Synthetic polypeptide
EIVMTQSPSTLSASVGDRVIITCRASQSISSWLAWYQQKPGKAPKLLIYKASSLESGVPSRFSGSGSGAEFTLTISSLQPDDFATYYCQQYKSYWTFGQGTKLTVLG

SEQ ID NO: 4125 - protein, 108 aa, Artificial Sequence
  Description of Artificial Sequence: Synthetic polypeptide
EIVLTQSPSSLSASVGDRVTLTCRASQGIRNELAWYQQRPGKAPKRLIYAGSILQSGVPSRFSGSGSGTEFTLTISSLQPEDVAVYYCQQYYSLPYMFGQGTKVDIKR

SEQ ID NO: 4126 - protein, 109 aa, Artificial Sequence
  Description of Artificial Sequence: Synthetic polypeptide
EIVMTQSPATLSVSPGESAALSCRASQGVSTNVAWYQQKPGQAPRLLIYGATTRASGVPARFSGSGSGTEFTLTINSLQSEDFAAYYCQQYKHWPPWTFGQGTKVEIKR

SEQ ID NO: 4127 - protein, 111 aa, Artificial Sequence
  Description of Artificial Sequence: Synthetic polypeptide
QSVLTQPPSVSAAPGQKVTISCSGSTSNIGDNYVSWYQQLPGTAPQLLIYDNTKRPSGIPDRFSGSKSGTSATLGITGLQTGDEADYYCGTWDSSLSGVVFGGGTKLTVLG

SEQ ID NO: 4128 - protein, 108 aa, Artificial Sequence
  Description of Artificial Sequence: Synthetic polypeptide
EIVLTQSPATLSLSPGERATLSCRASQTLTHYLAWYQQKPGQAPRLLIYDTSKRATGVPARFSGSGSGTDFTLTISSLEPEDSALYYCQQRNSWPHTFGGGTKLEIKR

SEQ ID NO: 4129 - protein, 109 aa, Artificial Sequence
  Description of Artificial Sequence: Synthetic polypeptide
SYVLTQPPSVSVAPGQTATVTCGGNNIGSKSVHWYQQKPGQAPVLVVYDDSDRPSGIPERFSGSNSGNTATLTIRRVEAGDEADYYCQVWDSSSDHNVFGSGTKVEIKR

SEQ ID NO: 4130 - protein, 109 aa, Artificial Sequence
  Description of Artificial Sequence: Synthetic polypeptide
LPVLTQPPSVSVAPGQTARISCGGNNIETISVHWYQQKPGQAPVLVVSDDSVRPSGIPERFSGSNSGNTATLTISRVEAGDEADYYCQVWDSSSDYVVFGGGTKLTVLG

SEQ ID NO: 4131 - protein, 108 aa, Artificial Sequence
  Description of Artificial Sequence: Synthetic polypeptide
ADIVLTQSPSSLSASVGDRVTLTCRASSSVNYMHWYQQRPGKPPKALIYATSNLASGVPSRFSGSGSGTEFTLTISSLQPEDVAVYYCQQWRTNPPTFGQGTKLEVKR

SEQ ID NO: 4132 - protein, 108 aa, Artificial Sequence
  Description of Artificial Sequence: Synthetic polypeptide
AEIVLTQSPSSLSASVGDRVTLTCRASQGIRNELAWYQQRPGKAPKRLIYAGSILQSGVPSFSGSGSGTEFTLTISSLQPEDVAVYYCQQYYSLPYMFGQGTKVDIKR

SEQ ID NO: 4133 - protein, 107 aa, Artificial Sequence
  Description of Artificial Sequence: Synthetic polypeptide
DIVLTQSPAILSASPGEKVTLTCRASSSVNYMHWYQQKPGSPPKAWIYATSNLASGVPDRFSASGSGTSYSLTISRVEAEDAATYYCQQWRTNPPTFGAGTKLELKR

SEQ ID NO: 4134 - protein, 113 aa, Artificial Sequence
  Description of Artificial Sequence: Synthetic polypeptide
  MOD_RES (1)..(1): Any amino acid
  MOD_RES (7)..(7): Any amino acid
  MOD_RES (10)..(10): Any amino acid
  MOD_RES (15)..(15): Any amino acid
  MOD_RES (50)..(50): Any amino acid
  MOD_RES (88)..(88): Any amino acid
  MOD_RES (109)..(109): Any amino acid
XVVMTQXPLXLPVTXGQPASISCKSSQSLLDSDGKTYLNWLQQRPGQSPXRLIYLVSKLDSGVPDRFSGSGSGTDFTLKISRVEAEDXGVYYCWQGTHFPRTFGGGTKXEIKR

SEQ ID NO: 4135 - protein, 119 aa, Artificial Sequence
  Description of Artificial Sequence: Synthetic polypeptide
  MOD_RES (3)..(3): Any amino acid
  MOD_RES (78)..(78): Any amino acid
  MOD_RES (87)..(88): Any amino acid
  MOD_RES (114)..(114): Any amino acid
EVXLVESGGGLVQPGGSLRLSCAGSGFTFSNYGMSWVRQAPGKGLEWVASIRSGGGRTYYSDNVKGRFTISRENAKNXLYLQMNSLXXEDTAVYYCVRYDHYSGSSDYWGQGTXVTVSS

SEQ ID NO: 4136 - protein, 113 aa, Artificial Sequence
  Description of Artificial Sequence: Synthetic polypeptide
DVVMTQSPLSLPVTLGQPASISCKSSQSLLDSDGKTYLNWLQQRPGQSPRRLIYLVSKLDSGVPDRFSGSGSGTDFTLKISRVEAEDVGVYYCWQGTHFPRTFGGGTKVEIKR

SEQ ID NO: 4137 - protein, 109 aa, Artificial Sequence
  Description of Artificial Sequence: Synthetic polypeptide
QAVVTQESALTTSPGGTVILTCRSSTGAVTTSNYANWVQEKPDHLFTGLIGGTSNRAPGVPVRFSGSLIGDKAALTITGAQTEDDAMYFCALWYSTHYVFGGGTKVTVL

SEQ ID NO: 4138 - protein, 109 aa, Artificial Sequence; identical to SEQ ID NO: 4137
  Description of Artificial Sequence: Synthetic polypeptide

SEQ ID NO: 4139 - protein, 113 aa, Artificial Sequence
  Description of Artificial Sequence: Synthetic polypeptide
DVVMTQTPLSLPVSLGDQASISCRSSQSLVHSNGDTFLHWYLQKPGQSPKLLIYKVSNRFSGVPDRFSGSGSGTDFTLKISRVEAEDLGIYFCSQSIHVPWTFGGGTKLEIKR

SEQ ID NO: 4140 - protein, 113 aa, Artificial Sequence
  Description of Artificial Sequence: Synthetic polypeptide
DVVMTQTPLSLPVSLGDQASISCRSSQSLVYSNGDTYLHWYLQKPGQSPKLLIYKVSNRFSGVPDRFSGSGSGTDFTLKISRVEAEDLGVYFCSQSTHVPWTFGGGTKLEIKR

SEQ ID NO: 4141 - protein, 132 aa, Artificial Sequence
  Description of Artificial Sequence: Synthetic polypeptide
MMSPAQFLFLLVLWIRETNGDVVMTQSPLSLPVTPGEPASISCKSSQSLLDSDGKTYLNWLLQKPGQSPQRLIYLVSKLDSGVPDRFSGSGSGTDFTLKISRVEAEDVGVYYCWQGTHFPRTFGQGTKVEIK

SEQ ID NO: 4142 - protein, 131 aa, Artificial Sequence
  Description of Artificial Sequence: Synthetic polypeptide
MKLPVRLLVLMFWIPASSSDVLMTQTPLSLPVSLGDQASISCRSSQNIIHSNGNTYLEWYLQKPGQSPKLLIYKVSNRFSGVPDRFSGSGSGTDFTLKIKKVEAEDLGIYYCFQGSHVPLTFGAGTKLELE

SEQ ID NO: 4143 - protein, 132 aa, Artificial Sequence
  Description of Artificial Sequence: Synthetic polypeptide
MMSPAQFLFLLVLWIRETNGYVVMTQTPLTLSVTIGQPASISCKSSQSLLDSDGKTYLNWLLQRPGQSPKRLIYLVSKLDSGVPDRFTGSGSGTDFTLKISRIEAEDLGLYYCWQGTHFPRTFGGGTKLEIK

SEQ ID NO: 4144 - protein, 132 aa, Artificial Sequence
  Description of Artificial Sequence: Synthetic polypeptide
MMSPAQFLFLLVLWIRETNGYVVMTQSPLSLPVTPGEPASISCKSSQSLLDSDGKTYLNWLLQKPGQSPQRLIYLVSKLDSGVPDRFSGSGSGTDFTLKISRVEAEDVGVYYCWQGTHFPRTFGQGTKVEIK

SEQ ID NO: 4145 - protein, 125 aa, Artificial Sequence
  Description of Artificial Sequence: Synthetic polypeptide
MGLLMLWVSGSSGDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 4146 - protein, 100 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTP

SEQ ID NO: 4147 - protein, 119 aa, Artificial Sequence [sequence omitted]

SEQ ID NO: 4148 - protein, 112 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK

SEQ ID NO: 4149 - protein, 112 aa, Artificial Sequence
  Description of Artificial Sequence: Synthetic polypeptide
DIVMTQSPLSLPVTPGEPASISCRVSQSLLHSNGYTYLHWYLQKPGQSPQLLIYKVSNRFSGVPDRFSGSGSGTDFTLKISRVEAEDVGVYYCSQTRHVPYTFGGGTKVEIK

SEQ ID NO: 4150 - protein, 444 aa, Artificial Sequence
  Description of Artificial Sequence: Synthetic polypeptide
EVQLVESGGGLVQPGGSLRLSCAVSGFTFSDNGMAWVRQAPGKGLEWVSFISNLAYSIDYADTVTGRFTISRDNAKNSLYLQMNSLRAEDTAVYYCVSGTWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCWVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4151 - protein, 110 aa, Artificial Sequence
  Description of Artificial Sequence: Synthetic polypeptide
DEIVLTQSPSSLSASIGDRVTITCRASESINKYVNWYQQKPGKAPKLLIYAASSLQSGAPSRVSGSGFGRDFSLTISGLQAEDFGAYFCQQSYSAPYTFGQGTKVEIKRT

SEQ ID NO: 4152 - protein, 115 aa, Artificial Sequence
  Description of Artificial Sequence: Synthetic polypeptide
QSVLTQPPSASGTPGQRVTISCSGSSSNIGSNYVYWYQQPPGTAPKLLIYRNNQRPSGVPDRFSGSKSGTSASLAISGLRSEDEADYYCAAWDDSLSGYVFGTGTKVTVLSYGIH

SEQ ID NO: 4153 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 4154 - protein, 121 aa, Artificial Sequence; identical to SEQ ID NO: 3776
  Description of Artificial Sequence: Synthetic polypeptide

SEQ ID NO: 4155 - protein, 108 aa, Artificial Sequence
  Description of Artificial Sequence: Synthetic polypeptide
DIQLTQSPSTLSASVGDRVTITCRASQSISSWLAWYQQIPGKAPKLLIYKASSLESGVPSRFSGSGSGTEFTLTISSLQPDDFATYYCQQYNSYSRTFGQGTKLEIKR

SEQ ID NO: 4156 - protein, 109 aa, Artificial Sequence
  Description of Artificial Sequence: Synthetic polypeptide
EIVLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLEIKRT

SEQ ID NO: 4157 - protein, 219 aa, Artificial Sequence
  Description of Artificial Sequence: Synthetic polypeptide
DVVMTQSPLSLPVTLGQPASISCRSSQNIIHSNGNTYLEWYLQKPGQSPRLLIYKVSNRFSGVPDRFSGSGSGTDFTLKISRVEAEDVGVYYCFQGSHVPLTFGGGTKVEFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4158 - protein, 113 aa, Artificial Sequence
  Description of Artificial Sequence: Synthetic polypeptide
  MOD_RES (3)..(3): Any amino acid
  MOD_RES (7)..(7): Any amino acid
  MOD_RES (14)..(14): Any amino acid
  MOD_RES (17)..(17): Any amino acid
  MOD_RES (30)..(30): Any amino acid
  MOD_RES (50)..(50): Any amino acid
  MOD_RES (88)..(88): Any amino acid
  MOD_RES (105)..(105): Any amino acid
  MOD_RES (109)..(109): Any amino acid
DVXMTQXPLSLPVXLGXPASISCRSSQNIXHSNGNTYLEWYLQKPGQSPXLLIYKVSNRFSGVPDRFSGSGSGTDFTLKFSRVEAEDXGVYYCFQGSHVPLTFGXGTKXEIKR

SEQ ID NO: 4159 - protein, 113 aa, Artificial Sequence
  Description of Artificial Sequence: Synthetic polypeptide
DVVMTQSPLSLPVTLGQPASISCRSSQNIIHSNGNTYLEWYLQKPGQSPRLLIYKVSNRFSGVPDRFSGSGSGTDFTLKISRVEAEDVGVYYCFQGSHVPLTFGGGTKVEIKR

SEQ ID NO: 4160 - protein, 98 aa, Artificial Sequence
  Description of Artificial Sequence: Synthetic polypeptide
SSLTVTAGEKVTMSCKSSQSLLAGRYQKNYLTWYQQKPGQPPKLLIYWASTRDSGVPDRFTGSGSGTDFTLTISSVQAEDLAVYYCQNDYTYPLTFAG

SEQ ID NO: 4161 - protein, 99 aa, Artificial Sequence
  Description of Artificial Sequence: Synthetic polypeptide
SSLTVTAGEKVTMNCKSSQNLLNSGNQVNYLTWFQQKPGQPPKLLIYWASTRESGVPDRFIGSGSGTDFTLTINSVQAEDLAVYYCQNDYRYPLTFGAG

SEQ ID NO: 4162 - protein, 99 aa, Artificial Sequence
  Description of Artificial Sequence: Synthetic polypeptide
SSLAVTAGERVTMSCKSSLTLLNSGSQTNYLTWYQQKPGQPPKLLIYWASTRESGVPDRFTGSGSGTDFTLTISSVQAEDLAVYYCQNDYSYPLTFGAG

SEQ ID NO: 4163 - protein, 99 aa, Artificial Sequence
  Description of Artificial Sequence: Synthetic polypeptide
SSLTVTAGEKVTMSCKSSQSLFNSGRQTNYLTWFQQRPGQAPKLLIYWASTRGSGVPDRFTGSGSGTEFTLTISSVQAEDLAVYYCQNDYTYPLTFGAG

SEQ ID NO: 4164 - protein, 99 aa, Artificial Sequence
  Description of Artificial Sequence: Synthetic polypeptide
SSLTVTAGEKVTMSCTSSQSLFNSGTQTNYLTWYQQKPGQPPKLLIYWASTRESGVPDRFTGSGSGTDFTLTISSVQAEDLAVYYCQNDYTYPLTFGAG

SEQ ID NO: 4165 - protein, 107 aa, Artificial Sequence
  Description of Artificial Sequence: Synthetic polypeptide
DVVMTQTPLSLPVSLGDQASISCRSSQSLLHSNGNTYLHWYLQKPGQSPKLLIYKVSNRFSGVPDRFSGSGSGTDFTLKISRVEAEDLGVYFCSQSTHVPLTFGAGT

SEQ ID NO: 4166 - protein, 86 aa, Artificial Sequence
  Description of Artificial Sequence: Synthetic polypeptide
SCRSSQSLVHSNGNTYLHWYLQKPGQSPKLLIYKVSNRFSGVPDRFSGSGSGTDFTLKISRVEAEDLGVYFCSQSTHVPLTFGAGT

SEQ ID NO: 4167 - protein, 134 aa, Artificial Sequence
  Description of Artificial Sequence: Synthetic polypeptide
MDTRAPTQLLGLLLLWLPGATFAQVLTQTPSPVSAAVGGTVTINCQSSQSLYNKNWLSWYQKKPGQPPKLLIYKASTLESGVSSRFKGSGSGTQFTLTISGVQCDDAATYYCQGEFSCSSADCTAFGGGTEVVV

SEQ ID NO: 4168 - protein, 112 aa, Artificial Sequence
  Description of Artificial Sequence: Synthetic polypeptide
DVVLTQTPLTLSVTIGQPASISCKSSQSLLYSNGKTYLNWLLQRPGQSPKRLIYVVSKLDSGVPDRFTGSGSGTDFTLKISRVEAEDLGVYYCVQGTHYPFTFGGGTKLEIK

SEQ ID NO: 4169 - protein, 107 aa, Artificial Sequence
  Description of Artificial Sequence: Synthetic polypeptide
DILMSQSPSSMSVSLGDRVSITCRASQGISSKMGWLQQKPGKSSKGLIYHGTKLEDGVPSRFSGSGSGAEYSLTISSLESEDFGDYYCVQYAQFPYTFGGGTKLEIK

SEQ ID NO: 4170 - protein, 107 aa, Artificial Sequence
  Description of Artificial Sequence: Synthetic polypeptide
DILMTQSPSSMSVSLGDTVSITCHASQGIRNNIGWLQEKPGKSFKGLIYHGTKLEDGIPSRFSGSGSGADYSLTISSLESEDVADYYCVQYDQFPYTFGGGTKLEIK

SEQ ID NO: 4171 - protein, 112 aa, Artificial Sequence
  Description of Artificial Sequence: Synthetic polypeptide
DVVLTQTPFTLSVTIGQPASISCKSSQSLLHSNGESYLNWLFQRPGQSPKRLIYAVSKLDSGVPDRFTGSGSGTDFTLKISRVEAEDLGVYYCVQGTHFPFTFGGGTKLEIK

SEQ ID NO: 4172 - protein, 107 aa, Artificial Sequence
  Description of Artificial Sequence: Synthetic polypeptide
SYELTQPPSVSVSPGQTARISCFGDTLPKQYTYWYQQKPGQAPVLVIYKDTERPSGIPERFSGSSSGTTVTLTISGVQAEDEADYYCLSADNSATWVFGGGTKVTVL

SEQ ID NO: 4173 - protein, 108 aa, Artificial Sequence
  Description of Artificial Sequence: Synthetic polypeptide
SYELTQPPSVSVSPGQTAGITCSGDALPKQFVYWYQKKPGQAPVLLIYKDTERPSRIPERFSGSTSGTTVALTINGVQAEDEADYYCQSADRSGALWVFGGGTKLTVL

SEQ ID NO: 4174 - protein, 108 aa, Artificial Sequence
  Description of Artificial Sequence: Synthetic polypeptide
SYELTQPPSVSVSPGQTARITCSGDALPKKYAYWYQQKSGQAPVLVIYEDNKRPSGIPERFSGSSSGTVATLTISGAQVDDEADYYCYSTDISGDLRVFGGGTKLTVL

SEQ ID NO: 4175 - protein, 112 aa, Artificial Sequence
  Description of Artificial Sequence: Synthetic polypeptide
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSFYLRTFGGGTKLDIK

SEQ ID NO: 4176 - protein, 112 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTLTFGGGTKVEIK

SEQ ID NO: 4177 - protein, 112 aa, Artificial Sequence
  Description of Artificial Sequence: Synthetic polypeptide
DIVMTQSPDSLAVSLGERATINCKSSQSLLNSRTRKNYLAWYQQKPGQSPKLLIYWASTRESGVPDRFSGSGSGTDFTLTISSLQAEDVAVYYCKQSFYLRTFGGGTKVEIK

SEQ ID NO: 4178 - protein, 112 aa, Artificial Sequence
  Description of Artificial Sequence: Synthetic polypeptide
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLRTFGGGTKLEIK

SEQ ID NO: 4179 - protein, 112 aa, Artificial Sequence
  Description of Artificial Sequence: Synthetic polypeptide
DIVMTQSPDSLAVSLGERATINCKSSQSVLNSRNNKNYLAWYQQKPGQPPKLLIYWASTRESGVPDRFSGSGSGTDFTLTISSLQAEDVAVYYCKQSFYLRTFGGGTKVEIK

SEQ ID NO: 4180 - protein, 112 aa, Artificial Sequence
  Description of Artificial Sequence: Synthetic polypeptide
DIVMTQSPDSLAVSLGERATISCKSSQSVLNSRNNKNYLAWYQQKPGQSPKLLIYWASTRESGVPDRFSGSGSGTDFTLTISSLQAEDVAVYYCKQSFYLRTFGGGTKVEIK

SEQ ID NO: 4181 - protein, 111 aa, Artificial Sequence
  Description of Artificial Sequence: Synthetic polypeptide
QSALTQPPSASGSPGHSVTISCTGTSSDVGQYSFVSWYQQYPGKAPKIIIYDVSKRSSGVPDRFFGSKSANTASLTVSGVQEEDEADYFCSSYGGSKYPWVFGGGTKLTVL

SEQ ID NO: 4182 - protein, 111 aa, Artificial Sequence
  Description of Artificial Sequence: Synthetic polypeptide
QSALTQPPSASGSPGHSVTISCTGTSSDVGQYSFVSWYQQYPGKAPKVIIYDVSKRSSGVPDRFFGSKSANTASLTVSGVQEEDEADYFCSSYGGSKYPWVFGGGTKLTVL

SEQ ID NO: 4183 - protein, 111 aa, Artificial Sequence
  Description of Artificial Sequence: Synthetic polypeptide
QSALTQPPSASGSPGHSVTISCTGTSSDVGNYSFVSWYQQYPGKAPKVIIYDVSKRSSGVPDRFFGSKSANTASLTVSGVQEEDEADYFCSSYGGSKYPWVFGGGTKLTVL

SEQ ID NO: 4184 - protein, 108 aa, Artificial Sequence
  Description of Artificial Sequence: Synthetic polypeptide
SYELTQPPSVSVSPGQTARITCSGDALPKRYVYWYQQKSGQAPVLVIYEDSKRPSGIPETFSGSSSGTMATLTISGAQVEDEADYYCYSTDSNGHHWVFGGGTKLTVL

SEQ ID NO: 4185 - protein, 113 aa, Artificial Sequence
  Description of Artificial Sequence: Synthetic polypeptide
DIVMTQSPDSLAVSLGERATINCKSSRSVLYSSNSKNYLAWYQQKPGQPPKLLIYWASTRESGVPDRFSGSGSGTEFTLTISSLQAEDVAVYYCQQYYGTPRTFGQGTKVEIK

SEQ ID NO: 4186 - protein, 108 aa, Artificial Sequence
  Description of Artificial Sequence: Synthetic polypeptide
SYVLTQPPSVSVAPGQTARFTCGGNNIASKSVHWYQQKPGQAPVLVVYDDSDRPSRIPERFSGSNSGNTATLTISRVEAGDEADYYCQVWDSTSDHVVFGGGTKLTVL

SEQ ID NO: 4187 - protein, 110 aa, Artificial Sequence
  Description of Artificial Sequence: Synthetic polypeptide
QSALTQPRSVSGSPGQSVTISCTGTSSDVGGYNYVSWHQQHPGKAPKLLIYDVTKRPSGVPDRFSGSKSGNTAALTISGLQAEDEADYYCHSYVGSYTLVFGGGTKLTVL

SEQ ID NO: 4188 - protein, 113 aa, Artificial Sequence
  Description of Artificial Sequence: Synthetic polypeptide
DIVMTQSPDSLAVSLGERATINCKSSQSVLYSSNNKDYLAWYQQKPGQPPKLLIYWASTRESGVSDRFSGSGSGTDFTLTISSLQAEDVAVYYCQQYYSTPITFGQGTRLEIK

SEQ ID NO: 4189 - protein, 107 aa, Artificial Sequence
  Description of Artificial Sequence: Synthetic polypeptide
DIQMTQSPSSLSASVGDRVTITCRASQGIVNNLAWFQQKPGKAPKSLIYAASSLQGGVPSKFSGSASGTDFSLTISNLQPEDFATYFCQQYNSYPWTFGQGTKVEIK

SEQ ID NO: 4190 - protein, 113 aa, Artificial Sequence
  Description of Artificial Sequence: Synthetic polypeptide
DIVMTQSPDSLAVSLGERATINCKSSQSVLYGSNNKNYLAWYQQKLGQSPKLLIYWASARESGVPDRFGGSGSGTDFTLTISSLQAEDVAVYYCQQYYSTPWTFGQGTKVEIK

SEQ ID NO: 4191 - protein, 113 aa, Artificial Sequence
  Description of Artificial Sequence: Synthetic polypeptide
EIVMTQSPDSLAVSLGERATINCKSSQNILYSSDNKNYLAWYQQKPGQPPKLLIYWASTRESGVPDRFSGSGSGTDFTLTISSLQAEDVAVYYCQQYYSIPRTFGQGTKVEIK

SEQ ID NO: 4192 - protein, 113 aa, Artificial Sequence
  Description of Artificial Sequence: Synthetic polypeptide
DIVMTQSPDSLAVSLGERATINCKSSQNILYSSDNKNYLAWYQQKPGQPPKLLIYWASTRESGVPDRFSGSGSGTDFTLTISSLQAEDVAVYYCQQYYSIPRTFGQGTKVEIK

SEQ ID NO: 4193 - protein, 113 aa, Artificial Sequence
  Description of Artificial Sequence: Synthetic polypeptide
DIVMTQSPDSLAVSLGERATINCKSSQTILYSSNNKNYLAWYQQKPGQPPKLLIYWASTRESGVPDRFSGSGSGTDFTLTISSLRAEDVAVYYCQQYYSSPQTFGQGTKVEIK

SEQ ID NO: 4194 - protein, 113 aa, Artificial Sequence
  Description of Artificial Sequence: Synthetic polypeptide
DVVMTQSPLSLPVTLGQPASISCTSSQSLLYSDGNTYLNWFQQRPGQSPRRLMYKVSKRDPGVPDRFSGSGSGTDFTLSISRVEAEDVGVYYCMQGSLWPRYTFGQGTKVEIK

SEQ ID NO: 4195 - protein, 113 aa, Artificial Sequence
  Description of Artificial Sequence: Synthetic polypeptide
DIVMTQSPDSLAVSLGERATINCKSSQTLLYTSNNQNYLAWYQHKPGQPPKVLIYWASTREYGVPDRFSGSGSGTDFTLTISSLQPEDVAVYYCQQYYNSPYTFGQGTKLEIK

SEQ ID NO: 4196 - protein, 110 aa, Artificial Sequence
  Description of Artificial Sequence: Synthetic polypeptide
QAGLTQPPSVSKDLRQTATLTCSGNSNNVGNQGAAWLQQFPGHPPKLLFYENINRPSGISERFSASRSGNTASLTITGLQPEDEADYYCSAWDGHLNAWVFGGGTKLTVL

SEQ ID NO: 4197 - protein, 113 aa, Artificial Sequence
  Description of Artificial Sequence: Synthetic polypeptide
DIVMTQSPDSLAVSLGERATINCKSSQTVLYTSNNKNYLAWYQQKPGQPPKLLIYWASTRESGVPDRFSGSGSGTDFTLTISSLQAEDVAVYYCQHYYSTPFTFGPGTKVDIK

SEQ ID NO: 4198 - protein, 108 aa, Artificial Sequence
  Description of Artificial Sequence: Synthetic polypeptide
LPVLTQPPSVSVSPGQTARITCSGDVLAETYARWFQQKPGQAPVLVMYRDRERPAGIPERFSGSSSGNTVTLTISGAQAEDEAVYHCHSVADNNLDWVFGGGTKLTVL

SEQ ID NO: 4199 - protein, 108 aa, Artificial Sequence
  Description of Artificial Sequence: Synthetic polypeptide
SYELTQPPSVSVSPGQTARITCSGDVLAETYARWFQQKPGQAPVLVMYRDRERPAGIPERFSGSSSGNTVTLTISGAQAEDEAVYHCHSVADNNLDWVFGGGTKLTVL

SEQ ID NO: 4200 - protein, 112 aa, Artificial Sequence
  Description of Artificial Sequence: Synthetic polypeptide
DVLMTQSPLSLPVTLGQPASISCKSSQSIVHSNGNTYLEWYLQKPGQSPQLLVYKVSNRFSGVPDRFSGSGSGTDFTLKISRVEAEDVGTYYCFQGSLVPWAFGGGTKVEIK

SEQ ID NO: 4201 - protein, 112 aa, Artificial Sequence
  Description of Artificial Sequence: Synthetic polypeptide
DVVMTQSPLSLPVTLGQPASISCKSSQSIVHSNGNTYLEWYLQKPGQSPQLLVYKVSNRFSGVPDRFSGSGSGTDFTLKISRVEAEDVGTYYCFQGSLVPWAFGGGTKVEIK

SEQ ID NO: 4202 - protein, 112 aa, Artificial Sequence
  Description of Artificial Sequence: Synthetic polypeptide
DVVMTQSPLSLPVTLGQPASISCKSSQSIVHSNGNTYLEWYLQKPGQSPQLLVYKVSNRFSGVPDRFSGSGSGTDFTLKISRVEAEDVGVYYCFQGSLVPWAFGGGTKVEIK

SEQ ID NO: 4203 - protein, 112 aa, Artificial Sequence
  Description of Artificial Sequence: Synthetic polypeptide
DVVMTQSPLSLPVTLGQPASISCKSSQSIVHSNGNTYLEWYLQKPGQSPQLLIYKVSNRFSGVPDRFSGSGSGTDFTLKISRVEAEDVGVYYCFQGSLVPWAFGGGTKVEIK

SEQ ID NO: 4204 - protein, 112 aa, Artificial Sequence
  Description of Artificial Sequence: Synthetic polypeptide
DIVMTQAAPSVPVTPGESVSISCRSSESLLHSNGNTYLYWFLQRPGQSPQLLIYRMSNLASGVPDRFSGSGSGTAFTLRISRVEAEDVGVYYCMQYLEYPLTFGAGTKLELK

SEQ ID NO: 4205 - protein, 107 aa, Artificial Sequence
  Description of Artificial Sequence: Synthetic polypeptide
DIKMTQSPSSMYASLGERVTITCKASQDINRYLNWFQQKPGKSPKTLIYRANRLLDGVPSRFSGSGSGQDYSLTISSLDYEDMGIYYCLQYDEFPLTFGDGTKLELK

SEQ ID NO: 4206 - protein, 113 aa, Artificial Sequence
  Description of Artificial Sequence: Synthetic polypeptide
DIVMTQSPSSLAMSVGQKVTMSCKSSQSVFNSGNQKNSLAWYQQKPGQSPKLLVYFASTRESGVPDRFIGSGSGTDFSLTISSVQAEDLADYFCQEHYTTPPTFGTGTKLELK

SEQ ID NO: 4207 - protein, 112 aa, Artificial Sequence
  Description of Artificial Sequence: Synthetic polypeptide
DVVMTQTPLSLPVSLGDQASISCRSSQRLVHSHGKTYLHWYLQKPGQSPKLLIYKVSNRFSGVPDRFSGSGSGTDFTLKISRVEAEDLGVYFCSQTAHFPYTFGGGTKLEIK

SEQ ID NO: 4208 - protein, 112 aa, Artificial Sequence
  Description of Artificial Sequence: Synthetic polypeptide
DVVMTQTPLSLPVSLGDQASISCRSSQSLVHSHGKTYLHWYLQKPGQSPKLLIYKVSNRFSGVPDRFSGSGSGTDFTLKISRVEAEDLGVYFCSQTAHFPYTFGGGTKLEIK

SEQ ID NO: 4209 - protein, 112 aa, Artificial Sequence
  Description of Artificial Sequence: Synthetic polypeptide
DVVMTQTPLSLPVSLGDQASISCRSSQSLLHSHGNTYLHWYLQKPGQSPKLLIYKVSNRFSGVPDRFSGSGSGTDFTLKISRVEAEDLGVYFCSQTAHFPYTFGGGTKLEIK

SEQ ID NO: 4210 - protein, 107 aa, Artificial Sequence
  Description of Artificial Sequence: Synthetic polypeptide
DIVMTQSHKFMSTSVGDRVSITCKASQDVSTAVAWYQQKPGQSPKLLIYSASYRYTGVPDRFTGSGSGTDFTFTISSVQAEDLAVYYCQQHYTTPLTFGAGTKLELK

SEQ ID NO: 4211 - protein, 112 aa, Artificial Sequence
  Description of Artificial Sequence: Synthetic polypeptide
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPFTFGSGTKLEI

SEQ ID NO: 4212 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKLSNRFSGVPDRFSGSGSGTDFTLKISRVEAEDLGVYYCFQGSHVPPTFGGGTKLEIK

SEQ ID NO: 4213 - protein, 112 aa, Artificial Sequence
  Description of Artificial Sequence: Synthetic polypeptide
NILMTQSPSSLAVSAGEKVTMSCKSSQSVLYSSNQKNYLAWYQQKPGQSPKLLIYWASTRESGVPDRFTGSGSGTDFTLTISSVQAEDLAVYYCLQYLSSLTFGAGTKLELK

SEQ ID NO: 4214 - protein, 112 aa, Artificial Sequence
  Description of Artificial Sequence: Synthetic polypeptide
  MOD_RES (3)..(3): Any amino acid
DIXMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLKSPYTFGGGTKLEIK

SEQ ID NO: 4215 - protein, 112 aa, Artificial Sequence
  Description of Artificial Sequence: Synthetic polypeptide
DVLMTQTPLSLPVSLGDQASISCRSSQSIVHSNGNTYLEWFLQKPGQSPKLLIYKVSNRFSGVPDRFSGSGSGTDFTLKISRVEAEDLGVYYCFQGSHVPYTFGGGTKLEIK

SEQ ID NO: 4216 - protein, 107 aa, Artificial Sequence
  Description of Artificial Sequence: Synthetic polypeptide
DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPYTFGGGTKLEIK

SEQ ID NO: 4217 - protein, 112 aa, Artificial Sequence
  Description of Artificial Sequence: Synthetic polypeptide
DIVMTQAAPSVPVTPGESVSISCRSSKSLLHSNGNTYLYWFLQRPGQSPQLLIHRMSNLASGVPDRFSGSGSGTAFTLRISRVEAEDVGVYYCMQHLKSPYTFGGGTKLEIK

SEQ ID NO: 4218 - protein, 112 aa, Artificial Sequence
  Description of Artificial Sequence: Synthetic polypeptide
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLKSPYTFGGGTKLEIK

SEQ ID NO: 4219 - protein, 112 aa, Artificial Sequence
  Description of Artificial Sequence: Synthetic polypeptide
DIVMTQTPLSLPVTPGEPASISCRSSQRLVHSHGKTYLHWYLQKPGQSPQLLIYKVSNRFSGVPDRFSGSGSGTDFTLKISRVEAEDVGVYFCSQTAHFPYTFGGGTKVEIK

SEQ ID NO: 4220 - protein, 112 aa, Artificial Sequence
  Description of Artificial Sequence: Synthetic polypeptide
DIVMTQTPLSLPVTPGEPASISCRSSQSLVHSHGKTYLHWYLQKPGQSPQLLIYKVSNRFSGVPDRFSGSGSGTDFTLKISRVEAEDVGVYFCSQTAHFPYTFGGGTKVEIK

SEQ ID NO: 4221 - protein, 130 aa, Artificial Sequence
  Description of Artificial Sequence: Synthetic polypeptide
LPVRLLVLMSWIPASSSDVLMTQIPVSLSVSLGDQASISCRSSESIVHSSGKTYLEWYLQKPGQSPKLLIYEVSNRFSGVPDRFSGSGSGTDFTLKISRVEAEDLGVYYCFQGSHVPWTFGGGTKLEIKR

SEQ ID NO: 4222 - protein, 131 aa, Artificial Sequence
  Description of Artificial Sequence: Synthetic polypeptide
KLPVRLLVLMSWIPASSSDVLMTQIPVSLSVSLGDQASISCRSSESIVHSSGKTYLEWYLQKPGQSPKLLIYEVSNRFSGVPDRFSGSGSGTDFTLKISRVEAEDLGVYYCFQGSHVPWTFGGGTKLEIKR

SEQ ID NO: 4223 - protein, 148 aa, Artificial Sequence
  Description of Artificial Sequence: Synthetic polypeptide
KLPVRLLVLMFWIPASSSDVLMTQTPLSLPVSLGDQASISCRSSQNILHSNGNTYLEWYLQKPGQSPKLLIYKVSSRFSGVPDRFSGSGSGTDFTLKITRVEAEDLGVYYCFQGSLVPWTFGGGTKLEIRRADAAPTVSIFPPSSEQL

SEQ ID NO: 4224 - protein, 121 aa, Artificial Sequence
  Description of Artificial Sequence: Synthetic polypeptide
DIVMSQSPSSLAVSVGEKVIMSCKSSQSLLYSTNQKNFLAWYQQKPGQSPKLLIYWASTRESGVPDRFTGSGSGTDFTLTISSLKAEDLAVYYCQQYYSYPYTFGGGTKLEIKRADAAPTV

SEQ ID NO: 4225 - protein, 112 aa, Artificial Sequence
  Description of Artificial Sequence: Synthetic polypeptide
EIVMTQAAPSVPVTPGESASISCRSNKSLLHSNGNTYLCWFLQRPGQSPQLLIYRMSTLAPGVPDRFSGSGSGTAFTLRISRLEAEDVGVYYCMQHIEYPLTFGAGTKLELK

SEQ ID NO: 4226 - protein, 112 aa, Artificial Sequence
  Description of Artificial Sequence: Synthetic polypeptide
QVLTQTASPVSAAVGSTVTINCQASQSVYKNNYLAWFQQKPGQPPKRLIYSASTLASGVSSRFKGSGSGTQFTLTISDVQCDDAATYYCLGSCDSSSNNCVAFGGGTEVVVK

SEQ ID NO: 4227 - protein, 107 aa, Artificial Sequence
  Description of Artificial Sequence: Synthetic polypeptide
QVLTQTASSVSAAVGGTVTINCQSSQSVYNNRLAWYQQKPGQPPKLLIYKASTLASGVPSRFKGSGSGTQFTLTISDLECDDAATYYCAGGYINIFAFGGGTEVVVK

SEQ ID NO: 4228 - protein, 112 aa, Artificial Sequence
  Description of Artificial Sequence: Synthetic polypeptide
QVLTQTASPVSAAVGSTVTINCQASQSVYKNNYLRWYQQKPGQPPKRLIYTASTLASGVSSRFKGSGSGTQFTLTISDVQCDDAATYYCLGGYDCNSADCWAFGGGTEVVVK

SEQ ID NO: 4229 - protein, 111 aa, Artificial Sequence
  Description of Artificial Sequence: Synthetic polypeptide
QVLTQTASPVSAAVGITVTISCQSSQSVRTNKLAWFQQKPGQPPKRLIYSASTLDSGVPSRFSASGSGTQFTLTISDVQCDDAATYYCLGYYDCSIADCVAFGGGTEVVVK

SEQ ID NO: 4230 - protein, 111 aa, Artificial Sequence
  Description of Artificial Sequence: Synthetic polypeptide
QVLTQTTSPVSAAVGSTVTISCQSSQSVRTNKLAWFQQKPGQPPKRLIYSASTLDFGVPSRFSASGSGTQFTLTISDVQCDDAATYYCLGYFDCSIADCVAFGGGTEVVVK

SEQ ID NO: 4231 - protein, 109 aa, Artificial Sequence
  Description of Artificial Sequence: Synthetic polypeptide
QVLTQTASSVSAAVGGTVTINCQSSQNVYNNNKLAWFQQKPGQPPKRLIYGASTLASGVSSRFKGSGSGTQFTLTISDLECDDAATYYCLGGYSGNIYTFGGGTEVVVK

SEQ ID NO: 4232 - protein, 106 aa, Artificial Sequence
  Description of Artificial Sequence: Synthetic polypeptide
DIVLTQSPSSLSASVGDRVTITCSASSSVSYMHWYQQKPGQAPKLLIYTTSNLASGVPSRFSGSGSGTDYTLTISSLQPEDVATYYCHQWSSYPWTFGGGTKVEIK

SEQ ID NO: 4233 - protein, 98 aa, Artificial Sequence; identical to SEQ ID NO: 3764
  Description of Artificial Sequence: Synthetic polypeptide

SEQ ID NO: 4234 - protein, 15 aa, Artificial Sequence
  Description of Artificial Sequence: Synthetic peptide
YFDYWGQGTLVTVSS

SEQ ID NO: 4235 - protein, 95 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWP

SEQ ID NO: 4236 - protein, 12 aa, Artificial Sequence
  Description of Artificial Sequence: Synthetic peptide
WTFGQGTKVEIK

SEQ ID NO: 4237 - protein, 453 aa, Artificial Sequence
  Description of Artificial Sequence: Synthetic polypeptide
EVKLLESGGGLVQPGGSLRLSCAASGFTFSTYTMSWVRQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4238 - protein, 235 aa, Artificial Sequence
  Description of Artificial Sequence: Synthetic polypeptide
MVLQTQVFISLLLWISGAYGDIVLTQSPATLSLSPGERATLSCRASQSVSSSYLAWYQQKPGQAPRLLIYGASSRATGVPARFSGSGSGTDFTLTISSLEPEDFATYYCLQIYNMPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4239 - protein, 109 aa, Artificial Sequence
  Description of Artificial Sequence: Synthetic polypeptide
DIQMTQSPSSLSASVGDRVTITCRASQGISSYLAWYQQKPGKAPKLLIYAASSLQSGVPSRFSGSGSGTDFTLTISSLQPEDFATYYCQQHYTTPPTFGQGTKVEIKRT

SEQ ID NO: 4240 - protein, 114 aa, Artificial Sequence; identical to SEQ ID NO: 3386
  Description of Artificial Sequence: Synthetic polypeptide

SEQ ID NO: 4241 - protein, 110 aa, Artificial Sequence; identical to SEQ ID NO: 3387
  Description of Artificial Sequence: Synthetic polypeptide

SEQ ID NO: 4242 - protein, 115 aa, Artificial Sequence; identical to SEQ ID NO: 3388
  Description of Artificial Sequence: Synthetic polypeptide

SEQ ID NO: 4243 - protein, 109 aa, Artificial Sequence; identical to SEQ ID NO: 3389
  Description of Artificial Sequence: Synthetic polypeptide

SEQ ID NO: 4244 - protein, 110 aa, Artificial Sequence; identical to SEQ ID NO: 3390
  Description of Artificial Sequence: Synthetic polypeptide

SEQ ID NO: 4245 - protein, 107 aa, Artificial Sequence
  Description of Artificial Sequence: Synthetic polypeptide
SYELTQPPSVSVAPGQTARISCSGDALGDKYASWYQQKPGQAPVLVIYDDSDRPSGIPERFSGSNSGNTATLTISGTQAEDEADYYCQQHYTTPPVFGGGTKLTVLG

SEQ ID NO: 4246 - protein, 120 aa, Artificial Sequence; identical to SEQ ID NO: 3464
  Description of Artificial Sequence: Synthetic polypeptide

SEQ ID NO: 4247 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGWINPNSGGTNYAQKFQGRVTMTRDTSISTAYMELSSLRSEDTAVYYCARWGGDGFYAMDYWGQGTLVTVSS

SEQ ID NO: 4248 - protein, 121 aa, Artificial Sequence; identical to SEQ ID NO: 3466
  Description of Artificial Sequence: Synthetic polypeptide

SEQ ID NO: 4249 - protein, 120 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCARWGGDGFYAMDYWGQGTLVTVSS

SEQ ID NO: 4250 - protein, 119 aa, Artificial Sequence; identical to SEQ ID NO: 3468
  Description of Artificial Sequence: Synthetic polypeptide

SEQ ID NO: 4251 - protein, 120 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWGGDGFYAMDYWGQGTLVTVSS

SEQ ID NO: 4252 - protein, 123 aa, Artificial Sequence; identical to SEQ ID NO: 3470
  Description of Artificial Sequence: Synthetic polypeptide

SEQ ID NO: 4253 - protein, 311 aa, Artificial Sequence
  Description of Artificial Sequence: Synthetic polypeptide
MKYLLPTAAAGLLLLAAQPAMAMAEVQLQQSGAELARPGTSVNLSCKTSGYSFTGYGVSWVKQRIGQGLEWIGEIYPRSGNTYYNEKFKGKATLTADKSSNTAYMELRSLTSEDSAVYFCARWNWERDAMDYWGQGTSVTVSSAKTTPPSDYPLAGGGGSGGGGSGGGGSDIVMTQTPLSLPVSLGDQASISCRSSQSLESSSGYPHLNWYLQKPGQSPQLLIYRVSNRFSGVLDRFSGSGSGTDFTLQISRVEAEDLGVYFCLQITHVPWTFGGGTKLEIKRADAAPTVSAAEEQKLISEEDLEHHHHHH

SEQ ID NO: 4254 - protein, 250 aa, Artificial Sequence
  Description of Artificial Sequence: Synthetic polypeptide
MAHVQFVQSGGDLVKPGGSLKLSCAASGFTFSSYGMSWVRQTPDKRLEWVATISSGGSYTYYPDSVKGRFTISRDNAKNTLYLQMSSLKSEDTAMYYCARHNYGSSYPYAMDYWGQGTPVTVSAGGGGSGGGASGGGGSEIMITQTPVIMSAFSGEKVTMTCSASSSVNYMHWYQQKSGTSPKKWIYDTSKLASGVPDRFSGSGSGTSYSLTISRMEAEDAATYYCPQWSSNPPMTFGGGTNLEMKRAAA

SEQ ID NO: 4255 - protein, 238 aa, Artificial Sequence
  Description of Artificial Sequence: Synthetic polypeptide
MAQVQLQQSGGGLVQPGGSLKLSCAASGFTFSRYGMSWVRQTPDKRLELVATINSNGGSTYYPDSVKGRFTISRDNAKNTLYLQMSSLKSADTAMYFCARGGYLDYWGQGTTVTVSSGGGGSGGGGSGGGGADIELTQSPSLGESVTITCLASQTIGTWLAWFQQKPGKSPQLLIYAATSLADGVPSRFSGSGSGTKFSFKISSLLAEDFVTYYCQQLYSTPYTFGGGTKLEIKRAAA

SEQ ID NO: 4256 - protein, 235 aa, Artificial Sequence
  Description of Artificial Sequence: Synthetic polypeptide
MDLQVQIISFLLISASVIISRGQIVLTQSPAIMSASPGEKVTMTCSASSSVSYMHWYQQKSGTSPKRWIYDTSKLASGVPARFSGSGSGTSYSLTISSMEAEDAATYFCHQWRSNPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRGEC

SEQ ID NO: 4257 - protein, 268 aa, Artificial Sequence
  Description of Artificial Sequence: Synthetic polypeptide
MADVKLQESGAELVKPGASVKLSCKASGYTFTSYYMYWVKQRPGQGLEWIGEINPSNGGTNFNEKFKSKATLTVDKSSSTAYMQLSSLTSEDSAVYYCTRDYRYAWFAYWGQGTLVTVSAESQSFPNVFPLAGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIKRADAAPTVS

SEQ ID NO: 4258 - protein, 185 aa, Artificial Sequence
  Description of Artificial Sequence: Synthetic polypeptide
ESPLQTPTEDGSEEPGSETSDAKSTPTAEDVTAPLVDEGAPGKQAAAQPHTEIPEGTTAEEAGIGDTPSLEDEAAGHVTQARMVSKSKDGGSDDKKAKGADGKTKIATPRGAAPPGQKGQANATRIPAKTPPAPKTPPSSGEPPKSGDRSGYSSPGSPGTPGSRSRTPSLPTPPTREPKKVAVVR

SEQ ID NO: 4259 - protein, 115 aa, Artificial Sequence; identical to SEQ ID NO: 3161
  Description of Artificial Sequence: Synthetic polypeptide

SEQ ID NO: 4260 - protein, 113 aa, Artificial Sequence; identical to SEQ ID NO: 3162
  Description of Artificial Sequence: Synthetic polypeptide

SEQ ID NO: 4261 - protein, 113 aa, Artificial Sequence; identical to SEQ ID NO: 3162
  Description of Artificial Sequence: Synthetic polypeptide

SEQ ID NO: 4262 - protein, 111 aa, Artificial Sequence
  Description of Artificial Sequence: Synthetic polypeptide
QPVLTQSPSVSAAPRQRVTISCSGSNSNIGSNTVNWFQQLPGRAPELLMYYDDLLAPGVSDRFSGSKSGTSASLAISGLQSEDEADYYCATWDDSLNGWVFGGGTKVTVLS

SEQ ID NO: 4263 - protein, 121 aa, Artificial Sequence
  Description of Artificial Sequence: Synthetic polypeptide
MGSQPVLTQSPSVSAAPRQRVTISVSGSNSNIGSNTVNWIQQLPGRAPELLMYDDDLLAPGVSDRFSGSRSGTSASLTISGLQSEDEADYYAATWDDSLNGWVFGGGTKVTVLSGHHHHHH

SEQ ID NO: 4264 - protein, 112 aa, Artificial Sequence
  Description of Artificial Sequence: Synthetic polypeptide
SRPVLTQSPSVSAAPRQRVTISVSGSNSNIGSNTVNWIQQLPGRAPELLMYDDDLLAPGVSDRFSGSRSGTSASLTISGLQSEDEADYYAATWDDSLNDWVFGGGTKVTVLS

SEQ ID NO: 4265 - protein, 267 aa, Artificial Sequence
  Description of Artificial Sequence: Synthetic polypeptide
SASQVQLVKSEAEVKKPGSSVRVSCKASGGTISSCAISWVRQAPGQGLEWMGGIIPMFDTTNYAQNFQGRVTITADESTSTAYMDLSSLRSEDTAVYYCARTYYHDTSDNDGTYGMDVWGQGTTVTVSSASTKGPSGILGSGGGGSGGGGSGGGGSQPVLTQSPSASGTPGQRVTISCSGSTSNIGNNAVNWFQQFPGKAPKLLVYYDDLLPSGVSDRFSGSKSGTSASLAISGLQSEDEADYYCATWDDSLNGWVFGGGTKVTVLS

SEQ ID NO: 4266 - protein, 267 aa, Artificial Sequence
  Description of Artificial Sequence: Synthetic polypeptide
SASQVQLVESEAEVKKPGSSVRVSCKASGGTISSCAISWVRQAPGQGLEWMGGIIPMFDTTNYAQNFQGRVTITADESTSTAYMDLSSLRSEDTAVYYCARTYYHDTRDNDGTYGMDVWGQGTTVTVSSASTKGPSGILGSGGGGSGGGGSGGGGSQPVLTQSPSASGTPGQRVTISCSGSSSNIGSNTVNWFQQLPGTAPELLMYYDDLLASGVSDRFSGSKSGTSASLAISGLQSEDEGDYYCASWDDNLNGWVFGGGTKLTVLS

SEQ ID NO: 4267 - protein, 242 aa, Artificial Sequence
  Description of Artificial Sequence: Synthetic polypeptide
MAQVQLQESGGGLVQPGGSLRLSCAASGFTFSSYSMSWVRQAPGKGLEWVAVISYDGSNKYYADSVKGRFTISRDNSKNTLYLQMNSLRAEDTAVYYCARDRYFDLWGRGTLVTVSSGGGGSGGGGSGGGGSQSALTQPASVSGSPGQSITISCTGTSSDIGAYNYVSWYQQYPGKAPKLLIYDVSNRPSGISNRFSGSKSGDTASLTISGLQAEDEADYYCSSFANSGPLFGGGTKVTVLG

SEQ ID NO: 4268 - protein, 445 aa, Artificial Sequence
  Description of Artificial Sequence: Synthetic polypeptide
QVQLVQSGAEVKKPGASVKVSCKASGYTFTSSYINWVRQAPGQGLEWMGTINPVSGSTSYAQKFQGRVTMTRDTSISTAYMELSRLRSDDTAVYYCARGGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4269 - protein, 445 aa, Artificial Sequence; identical to SEQ ID NO: 4268
  Description of Artificial Sequence: Synthetic polypeptide

SEQ ID NO: 4270 - protein, 121 aa, Artificial Sequence
  Description of Artificial Sequence: Synthetic polypeptide
QVTLKESGGGLVQPGGSLRLSCAASGFTFSRYVINWVRQAPGKGLEWVSAISVTGGSTAYADSVRGRFTISRDNSKNTLYLQMNSLRAEDTAVYYCTKGQWERGSYYFDYWGRGTLVTVSS

SEQ ID NO: 4271 - protein, 117 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDENWGFDPWGQGTLVTVSS

SEQ ID NO: 4272 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCERMGPCTGGSCYDTLGNWGRGTLVTVSS

SEQ ID NO: 4273 - protein, 447 aa, Artificial Sequence
  Description of Artificial Sequence: Synthetic polypeptide
EVQVLESGGDLVQPGGSLRLSCAASGFTFSAYAMTWVRQAPGKGLEWVSAISGSGGSAYYADSVKGRFTISRDNSKNTVYLQMNSLRAEDTAVYYCAKDGAWKMSGLDVWGQGTTVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4274 - protein, 445 aa, Artificial Sequence
  Description of Artificial Sequence: Synthetic polypeptide
EVQLLESGGGLVQPGGSLRLSCAASGFTFSSYAMSWVRQAPGKGLEWVSTISSGGSYTSYPDSVKGRFTISRDNSKNTLYLQMNSLRAEDTAVYYCAKQDYAMNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4275 - protein, 456 aa, Artificial Sequence
  Description of Artificial Sequence: Synthetic polypeptide
QVQLVQSGSELKKPGASVKVSCKASGYTFTNYGMNWVRQAPGQGLEWMGWINTYTGEPTYADDFTGRFVFSLDTSVSTAYLQISSLKAEDTAVYYCARNPINYYGINYEGYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4276 - protein, 439 aa, Artificial Sequence
  Description of Artificial Sequence: Synthetic polypeptide
EVQLVESGGGLVQPGGSLRLSCAASGLTFSRYPMSWVRQAPGKGLVWVSAITSSGGSTYYSDTVKGRFTISRDNAKNTLYLQMNSLRAEDTAVYYCARLPDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4277 - protein, 454 aa, Artificial Sequence
  Description of Artificial Sequence: Synthetic polypeptide
EVQLQQSGPELVKPGASVKISCKASGYSFTGYFMHWVKQSHGNILDWIGNIYPYNGVSNYNQRFKAKATLTVDKSSSTAYMELRSLTSEDSAVYYCARRYYYGTGPADWYFDVWGTGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4278 - protein, 454 aa, Artificial Sequence
  Description of Artificial Sequence: Synthetic polypeptide
QVQLVQSGAEVKKPGASVKVSCKASGYTFTGYFMHWVRQAPGQGLEWMGNIYPYNGVSNYNQRFKARVTMTTDTSTSTAYMELRSLRSDDTAVYYCARRYYYGTGPADWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4279 - protein, 454 aa, Artificial Sequence
  Description of Artificial Sequence: Synthetic polypeptide
QVQLVQSGAEVKKPGASVKVSCKASGYTFTGYFMHWVRQAPGQGLEWMGNIYPYNGVSNYNQRFKARVTMTTDTSTSTAYMELRSLRSDDTAVYYCARRYYYGTGPADWYFDVWGTGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4280 - protein, 454 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNGVSNYNQRFKARVTMTTDTSTSTAYMELRSLRSDDTAVYYCARRYYYGTGPADWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4281 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNSVSNYNQRFKARVTMTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4282 - protein, 448 aa, Artificial Sequence
  Description of Artificial Sequence: Synthetic polypeptide
QVQLVQSGAEVKKPGASVKVSCKASGYSFTGYFMHWVRQAPGQGLEWIGNIYPYNSVSNYNQRFKARATLTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4283 - protein, 447 aa, Artificial Sequence
  Description of Artificial Sequence: Synthetic polypeptide
QVQLVQSGAEVKKPGASVKISCKASGYSFTGYFMHWVRQAPGQGLEWIGNIYPYNSVSNYNQRFKAKATLTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPG

SEQ ID NO: 4284 - protein, 448 aa, Artificial Sequence
  Description of Artificial Sequence: Synthetic polypeptide
QVQLVQSGAEVKKPGASVKVSCKASGYSFTGYFMHWVRQAPGQGLEWIGNIYPYNGVSNYNQRFKARATLTTDTSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4285 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNGVSNYNQRFKARVTMTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4286 - protein, 448 aa, Artificial Sequence
  Description of Artificial Sequence: Synthetic polypeptide
QVQLVQSGAEVKKPGASVKVSCKASGYSFTGYFMHWVRQAPGQGLEWIGNIYPYNGVSNYNQRFKARATLTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4287 - protein, 448 aa, Artificial Sequence
  Description of Artificial Sequence: Synthetic polypeptide
QVQLVQSGAEVKKPGASVKISCKASGYSFTGYFMHWVRQAPGQGLEWIGNIYPYNGVSNYNQRFKAKATLTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4288 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNSVSNYNQRFKARVTMTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4289 - protein, 448 aa, Artificial Sequence
  Description of Artificial Sequence: Synthetic polypeptide
QVQLVQSGAEVKKPGASVKVSCKASGYSFTGYFMHWVRQAPGQGLEWIGNIYPYNSVSNYNQRFKARATLTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4290 - protein, 448 aa, Artificial Sequence
  Description of Artificial Sequence: Synthetic polypeptide
QVQLVQSGAEVKKPGASVKISCKASGYSFTGYFMHWVRQAPGQGLEWIGNIYPYNSVSNYNQRFKAKATLTVDKSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4291 - protein, 448 aa, Artificial Sequence
  Description of Artificial Sequence: Synthetic polypeptide
EVQLQQSGPELVKPGASVKISCKASGYSFTGYFMHWVKQSHGNILDWIGNIYPYNGVSNYNQRFKAKATLTVDKSSSTAYMELRSLTSEDSAVYYCARRYYYGTGPADWYFDVWGTGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4292 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNGVSNYNQRFKARVTMTTDTSTSTAYMELRSLRSDDTAVYYCARRYYYGTGPADWYFDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4293 - protein, 448 aa, Artificial Sequence
  Description of Artificial Sequence: Synthetic polypeptide
EVQLQQSGPELVKPGASVKISCKASGYSFTGYFMHWVKQSHGNILDWIGNIYPYDGVSNYNQRFKAKATLTVDKSSSTAYMELRSLTSEDSAVYYCARRYYYGTGPADWYFDVWGTGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4294 - protein, 448 aa, Artificial Sequence
  Description of Artificial Sequence: Synthetic polypeptide
EVQLQQSGPELVKPGASVKISCKASGYSFTGYFMHWVKQSHGNILDWIGNIYPYQGVSNYNQRFKAKATLTVDKSSSTAYMELRSLTSEDSAVYYCARRYYYGTGPADWYFDVWGTGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4295 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYDGVSNYNQRFKARVTMTTDTSTSTAYMELRSLRSDDTAVYYCARRYYYGTGPADWYFDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4296 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYQGVSNYNQRFKARVTMTTDTSTSTAYMELRSLRSDDTAVYYCARRYYYGTGPADWYFDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4297 - protein, 448 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNGVSNYNQRFKARVTMTTDTSTSTAYMELRSLRSDDTAVYYCARRYYYGTGPADWYYDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 4298 - protein, 115 aa, Artificial Sequence
  Description of Artificial Sequence: Synthetic polypeptide
EVQLVESGGGLVQPGGSLRLSCAASGFTFSNYWMNWVRQAPGKGLEWVAQIRLKSDNYATHYAESVKGRFTISRDNAKNSLYLQMNSLRAEDTAVYYCARGLDYWGQGTTVTVSS

SEQ ID NO: 4299 - protein, 115 aa, Artificial Sequence
  Description of Artificial Sequence: Synthetic polypeptide
EVQLVESGGGLVQPGGSLRLSCAASGFTFRNYWCNWVRQAPGKGLEWVAQIRLKSDNYATHYAESVKGRFTISRDNAKNSLYLQMNSLRAEDTAVYYCTEGLDYWGQGTTVTVSS

SEQ ID NO: 4300 - protein, 115 aa, Artificial Sequence
  Description of Artificial Sequence: Synthetic polypeptide
  MOD_RES (50)..(50): Any amino acid
EVQLVESGGGLVQPGGSLRLSCAASGFTFSRYWMNWVRQAPGKGLEWVAXIRLKSDNYATHYAESVKGRFTISRDNAKNSLYLQMNSLRAEDTAVYYCTEGLDYWGQGTTVTVSS

SEQ ID NO: 4301 - protein, 115 aa, Artificial Sequence
  Description of Artificial Sequence: Synthetic polypeptide
EVQLVESGGGLVQPGGSLRLSCAASGFTFSNYWLNWVRQAPGKGLEWVAQIRLKSDNYATHYAESVKGRFTISRDNAKNSLYLQMNSLRAEDTAVYYCTEGLDYWGQGTTVTVSS

SEQ ID NO: 4302 - protein, 115 aa, Artificial Sequence; identical to SEQ ID NO: 4299
  Description of Artificial Sequence: Synthetic polypeptide

SEQ ID NO: 4303 - protein, 115 aa, Artificial Sequence; identical to SEQ ID NO: 4299
  Description of Artificial Sequence: Synthetic polypeptide

SEQ ID NO: 4304 - protein, 115 aa, Artificial Sequence; identical to SEQ ID NO: 4299
  Description of Artificial Sequence: Synthetic polypeptide

SEQ ID NO: 4305 - protein, 115 aa, Artificial Sequence; identical to SEQ ID NO: 4301
  Description of Artificial Sequence: Synthetic polypeptide

SEQ ID NO: 4306 - protein, 115 aa, Artificial Sequence; identical to SEQ ID NO: 4299
  Description of Artificial Sequence: Synthetic polypeptide

SEQ ID NO: 4307 - protein, 443 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFKSKATMTRDTSTSTAYMELSSLRSEDTAVYYCELMQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4308 - protein, 444 aa, Artificial Sequence
  Description of Artificial Sequence: Synthetic polypeptide
QVNLRESGGGLVRPGGSLRLSCAASGFTVSGYAMSWVRQAPGKGLEWVSAISRFSDTTYSADSVKGRFTISRDNSKNTVYLQMNSLRAEDSAVYYCARDPSGHGMDVWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4309 - protein, 115 aa, Artificial Sequence
  Description of Artificial Sequence: Synthetic polypeptide
  MOD_RES (30)..(31): Any amino acid
  MOD_RES (34)..(34): Any amino acid
  MOD_RES (99)..(100): Any amino acid
EVQLVESGGGLVQPGGSLRLSCAASGFTFXXYWXNWVRQAPGKGLEWVAQIRLKSDNYATHYAESVKGRFTISRDNAKNSLYLQMNSLRAEDTAVYYCXXGLDYWGQGTTVTVSS

SEQ ID NO: 4310 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4311 - protein, 120 aa, Artificial Sequence
  Description of Artificial Sequence: Synthetic polypeptide
QVQLVQSGAEVKKPGASVKVSCKASGYTFTSYWMQWVRQAPGQGLEWMGAIYPGDGDTRYTQKFKGRVTMTRDTSTSTVYMELSSLRSEDTAVYYCARMGGYDRYYFDYWGQGTLVTVSS

SEQ ID NO: 4312 - protein, 116 aa, Artificial Sequence
  Description of Artificial Sequence: Synthetic polypeptide
EVQLVESGGGLVQPGGSLRLSCAASGFTFSSYAMSWVRQAPEKRLEWVATISSGGSYTSYPDSVKGRFTISRDNSKNTLYLQMNSLRAEDTAMYYCAKQDYAMNYWGQGTMVTVSS

SEQ ID NO: 4313 - protein, 116 aa, Artificial Sequence
  Description of Artificial Sequence: Synthetic polypeptide
EVQLLESGGGLVQPGGSLRLSCAASGFTFSSYAMSWVRQAPGKGLEWVSTISSGGSYTSYPDSVKGRFTISRDNSKNTLYLQMNSLRAEDTAVYYCAKQDYAMNYWGQGTMVTVSS

SEQ ID NO: 4314 - protein, 120 aa, Artificial Sequence
  Description of Artificial Sequence: Synthetic polypeptide
EVQVLESGGDLVQPGGSLRLSCAASGFTFSAYAMTWVRQAPGKGLEWVSAISGSGGSAYYADSVKGRFTISRDNSKNTVYLQMNSLRAEDTAVYYCAKDGAWKMSGLDVWGQGTTVIVSS

SEQ ID NO: 4315 - protein, 117 aa, Artificial Sequence; identical to SEQ ID NO: 4271
  Description of Artificial Sequence: Synthetic polypeptide

SEQ ID NO: 4316 - protein, 124 aa, Artificial Sequence
  Description of Artificial Sequence: Synthetic polypeptide
QVQLVQSGAEVKKPGASVKVSCKASGYSFTGYFMHWVRQAPGQGLEWMGNIYPYNGVSNYNQRFKARVTMTTDTSTSTAYMELRSLRSDDTAVYYCARRYYYGTGPADWYFDVWGQGTLVTVSS

SEQ ID NO: 4317 - protein, 124 aa, Artificial Sequence
  Description of Artificial Sequence: Synthetic polypeptide
EVQLQQSGPELVKPGASVKISCKASGYSFTGYFMHWVKQSHGNILDWIGNIYPYDGVSNYNQRFKAKATLTVDKSSSTAYMELRSLTSEDSAVYYCARRYYYGTGPADWYFDVWGTGTLVTVSS

SEQ ID NO: 4318 - protein, 124 aa, Artificial Sequence
  Description of Artificial Sequence: Synthetic polypeptide
EVQLQQSGPELVKPGASVKISCKASGYSFTGYFMHWVKQSHGNILDWIGNIYPYQGVSNYNQRFKAKATLTVDKSSSTAYMELRSLTSEDSAVYYCARRYYYGTGPADWYFDVWGTGTLVTVSS

SEQ ID NO: 4319 - protein, 124 aa, Artificial Sequence
  Description of Artificial Sequence: Synthetic polypeptide
QVQLVQSGAEVKKPGASVKVSCKASGYSFTGYFMHWVRQAPGQGLEWMGNIYPYDGVSNYNQRFKARVTMTTDTSTSTAYMELRSLRSDDTAVYYCARRYYYGTGPADWYFDVWGQGTLVTVSS

SEQ ID NO: 4320 - protein, 124 aa, Artificial Sequence
  Description of Artificial Sequence: Synthetic polypeptide
QVQLVQSGAEVKKPGASVKVSCKASGYSFTGYFMHWVRQAPGQGLEWMGNIYPYQGVSNYNQRFKARVTMTTDTSTSTAYMELRSLRSDDTAVYYCARRYYYGTGPADWYFDVWGQGTLVTVSS

(The sequence listing continues in the following parts.)

The invention claimed is:

1. An adeno-associated virus (AAV) particle comprising a capsid and a viral genome, said viral genome comprising at least one inverted terminal repeat (ITR) region and a payload region, said payload region comprising a first nucleic acid segment and a second nucleic acid segment, wherein the first nucleic acid segment encodes a payload antibody polypeptide comprising SEQ ID NO: 3461 and the second nucleic acid segment encodes a payload antibody polypeptide comprising SEQ ID NO: 3900.

2. The AAV particle of claim 1, wherein the viral genome is single stranded or is self-complementary.

3. The AAV particle of claim 1, wherein at least one region of the viral genome is codon-optimized.

4. The AAV particle of claim 3, wherein the first nucleic acid segment is codon-optimized, wherein the second nucleic acid segment is codon-optimized, or wherein both the first nucleic acid segment and the second nucleic acid segment are codon-optimized.

5. The AAV particle of claim 1, wherein the payload region comprises from 5' to 3', the first nucleic acid segment and the second nucleic acid segment.

6. The AAV particle of claim 1, wherein the payload region comprises from 5' to 3', the second nucleic acid segment and the first nucleic acid segment.

7. The AAV particle of claim 1, wherein the payload region comprises from 5' to 3', the first nucleic acid segment, a linker sequence, and the second nucleic acid segment.

8. The AAV particle of claim 7, wherein the linker sequence encodes a T2A peptide, an internal ribosome entry site (IRES), F2A peptide, a furin cleavage site, a glycine serine linker, or a combination thereof.

9. The AAV particle of claim 1, wherein the payload region comprises from 5' to 3', the second nucleic acid segment, a linker sequence, and the first nucleic acid segment.

10. The AAV particle of claim 9, wherein the linker sequence encodes a T2A peptide, an internal ribosome entry site (IRES), F2A peptide, a furin cleavage site, a glycine serine linker, or a combination thereof.

11. A pharmaceutical composition comprising an AAV particle of claim 1 in a pharmaceutically acceptable excipient.

12. The pharmaceutical composition of claim 11, wherein the pharmaceutically acceptable excipient is saline.

13. The pharmaceutical composition of claim 11, wherein the pharmaceutically acceptable excipient is 0.001% pluronic in a phosphate-buffered saline.

14. The AAV particle of claim 1, wherein the capsid comprises an AAV9 capsid protein, an AAV2 capsid protein, or functional variant thereof.

15. The AAV particle of claim 1, wherein the viral genome further comprises a promoter operably linked to the payload region.

16. The AAV particle of claim 15, wherein the promoter comprises a tissue specific promoter or a ubiquitous promoter.

17. The AAV particle of claim 15, wherein the promoter comprises an EF-1a promoter, a chicken β-actin (CBA) promoter and/or its derivative CAG, a cytomegalovirus (CMV) immediate-early enhancer and/or promoter, a β glucuronidase (GUSB) promoter, a ubiquitin C (UBC) promoter, a neuron-specific enolase (NSE), a platelet-derived growth factor (PDGF) promoter, a platelet-derived growth factor B-chain (PDGF-β) promoter, an intercellular adhesion molecule 2 (ICAM-2) promoter, a synapsin promoter, a methyl-CpG binding protein 2 (MeCP2) promoter, a Ca2+/calmodulin-dependent protein kinase II (CaMKII) promoter, a metabotropic glutamate receptor 2 (mGluR2) promoter, a neurofilament light (NFL) or heavy (NFH) promoter, a β-globin minigene nβ2 promoter, a preproenkephalin (PPE) promoter, an enkephalin (Enk) and excitatory amino acid transporter 2 (EAAT2), a glial fibrillary acidic protein (GFAP) promoter, a myelin basic protein (MBP) promoter or a functional variant thereof.

18. The AAV particle of claim 1, wherein the viral genome further comprises:
(i) an enhancer;
(ii) an intron;
(iii) a Kozak sequence; and/or
(iv) a polyadenylation sequence.

19. The AAV particle of claim 18, wherein the enhancer comprises a Cytomegalovirus Major Immediate-Early (CMVie) enhancer.

20. The AAV particle of claim 18, wherein the intron comprises a D-globin intron or an SV40 intron.

21. The AAV particle of claim 1, wherein the viral genome comprises a first ITR region positioned 5' relative to the payload region and a second ITR region positioned 3' relative to the payload region.

22. The AAV particle of claim 1, wherein the antibody polypeptide encoded by the first nucleic acid segment and the antibody polypeptide produced by the second nucleic acid segment are expressed as a single polypeptide.

23. The AAV particle of claim 22, wherein the single polypeptide comprises a cleavage site present between the antibody polypeptide encoded by the first nucleic acid segment and the antibody polypeptide produced by the second nucleic acid segment.

24. The AAV particle of claim 23, wherein the cleavage site comprises a T2A cleavage site, an F2A cleavage site, a furin cleavage site, or a combination thereof.

* * * * *